United States Patent
Xue et al.

(10) Patent No.: US 12,458,688 B2
(45) Date of Patent: Nov. 4, 2025

(54) EPITOPES

(71) Applicant: Scancell Limited, Oxfordshire (GB)

(72) Inventors: Wei Xue, Oxfordshire (GB); Katherine Wendy Cook, Oxfordshire (GB); Linda Gillian Durrant, Oxfordshire (GB); Victoria Anne Brentville, Oxfordshire (GB)

(73) Assignee: Scancell Limited, Oxford (GB)

( * ) Notice: Subject to any disclaimer, the term of this patent is extended or adjusted under 35 U.S.C. 154(b) by 1238 days.

(21) Appl. No.: 17/275,030

(22) PCT Filed: Sep. 11, 2019

(86) PCT No.: PCT/EP2019/074273
§ 371 (c)(1),
(2) Date: Mar. 10, 2021

(87) PCT Pub. No.: WO2020/053304
PCT Pub. Date: Mar. 19, 2020

(65) Prior Publication Data
US 2022/0288178 A1    Sep. 15, 2022

(30) Foreign Application Priority Data
Sep. 14, 2018   (GB) ..................................... 1815041

(51) Int. Cl.
| A61K 39/00 | (2006.01) |
| C07K 7/08 | (2006.01) |
| C07K 14/47 | (2006.01) |
| C07K 14/725 | (2006.01) |
| C12N 9/88 | (2006.01) |

(52) U.S. Cl.
CPC .. A61K 39/001176 (2018.08); A61K 39/0011 (2013.01); C07K 7/08 (2013.01); C07K 14/47 (2013.01); C07K 14/4702 (2013.01); C07K 14/4741 (2013.01); C07K 14/7051 (2013.01); C12N 9/88 (2013.01); C12Y 401/02013 (2013.01); C12Y 402/01011 (2013.01)

(58) Field of Classification Search
CPC .. A61K 39/00; A61K 39/001177; C07K 7/08; C07K 14/47; C07K 14/4741; C07K 14/4702; C07K 14/7051; C12N 9/88; C12Y 402/01011
See application file for complete search history.

(56) References Cited

U.S. PATENT DOCUMENTS

| 5,951,985 | A | 9/1999 | Butler et al. |
| 10,233,220 | B2 | 3/2019 | Durrant et al. |
| 10,695,438 | B2 | 6/2020 | Durrant et al. |
| 2003/0138425 | A1 | 7/2003 | Mather |
| 2004/0013649 | A1 | 1/2004 | Tam et al. |
| 2005/0048070 | A1 | 3/2005 | Ditzel et al. |
| 2005/0202009 | A1 | 9/2005 | Kropshofer et al. |
| 2006/0014225 | A1 | 1/2006 | Georges et al. |
| 2007/0122414 | A1 | 5/2007 | Georges |
| 2007/0248539 | A1 | 10/2007 | Glass et al. |
| 2007/0248628 | A1 | 10/2007 | Keller et al. |
| 2009/0148400 | A1 | 6/2009 | Sing et al. |
| 2009/0155822 | A1 | 6/2009 | Bang et al. |
| 2009/0263376 | A1 | 10/2009 | Grunewald et al. |
| 2010/0260667 | A1 | 10/2010 | Georges et al. |
| 2010/0324270 | A1 | 12/2010 | Hestir et al. |
| 2011/0070253 | A1 | 3/2011 | Rammensee et al. |
| 2011/0293637 | A1 | 12/2011 | Hacohen et al. |
| 2012/0295292 | A1 | 11/2012 | Thompson et al. |
| 2013/0274125 | A1 | 10/2013 | Binder et al. |
| 2015/0125964 | A1 | 5/2015 | Leeming et al. |
| 2015/0232525 | A1 | 8/2015 | Durrant et al. |
| 2018/0346537 | A1 | 12/2018 | Durrant et al. |
| 2020/0330605 | A1 | 10/2020 | Durrant et al. |
| 2023/0192790 | A1 | 6/2023 | Durrant et al. |

FOREIGN PATENT DOCUMENTS

| CA | 2614103 A1 | 1/2007 |
| EP | 1541585 A1 | 6/2005 |
| JP | 2006-515268 A | 5/2006 |
| JP | 2009-527498 A | 7/2009 |
| JP | 2010-501475 A | 1/2010 |
| JP | 2014-505884 A | 3/2014 |
| WO | WO 2001/027269 A2 | 4/2001 |
| WO | WO 2002/034287 A2 | 5/2002 |
| WO | WO 2002/058728 A2 | 8/2002 |

(Continued)

OTHER PUBLICATIONS

Brentville, et al., Cancer Res 2016 76(3):548 (Year: 2016).*
Meyer, et al., Cancer Immunol Immunother 2014 63:247 (Year: 2014).*
Gabrilovich, et al., Cancer Immunol Res 2017 5(1):3 (Year: 2017).*
Brentville, V. A. et al., "T cell repertoire to citrullinated self-peptides in healthy humans is not confined to the HLA-DR SE alleles; Targeting of citrullinated self-peptides presented by HLA-DP4 for tumour therapy", Oncoimmunology, vol. 8, No. 5, Feb. 20, 2019, 1-14.
Brentville, V. A. et al., "Citrullinated Vimentin Presented on MHC-II in Tumor Cells Is a Target for CD4+ T-Cell-Mediated Antitumor Immunity", Cancer Res., vol. 76, No. 3, Feb. 1, 2016, 548-560.

(Continued)

*Primary Examiner* — Anne M. Gussow
*Assistant Examiner* — Sydney Van Druff
(74) *Attorney, Agent, or Firm* — Wolf, Greenfield & Sacks, P.C.

(57) ABSTRACT

The present invention relates to epitopes containing homocitrulline (Hcit) that can be used as targets for cancer immunotherapy. The homocitrullinated T cell epitope has (i) a predicted binding score to MIC class II or class I of <30 using the online IEDB prediction program (http://www.iedb.org/) and (ii) at least 5 consecutive amino acids that form a spiral conformational structure. These modified peptides can be used as vaccines or as targets for T cell receptor (TCR) and adoptive T cell transfer therapies.

8 Claims, 118 Drawing Sheets

Figure 1:
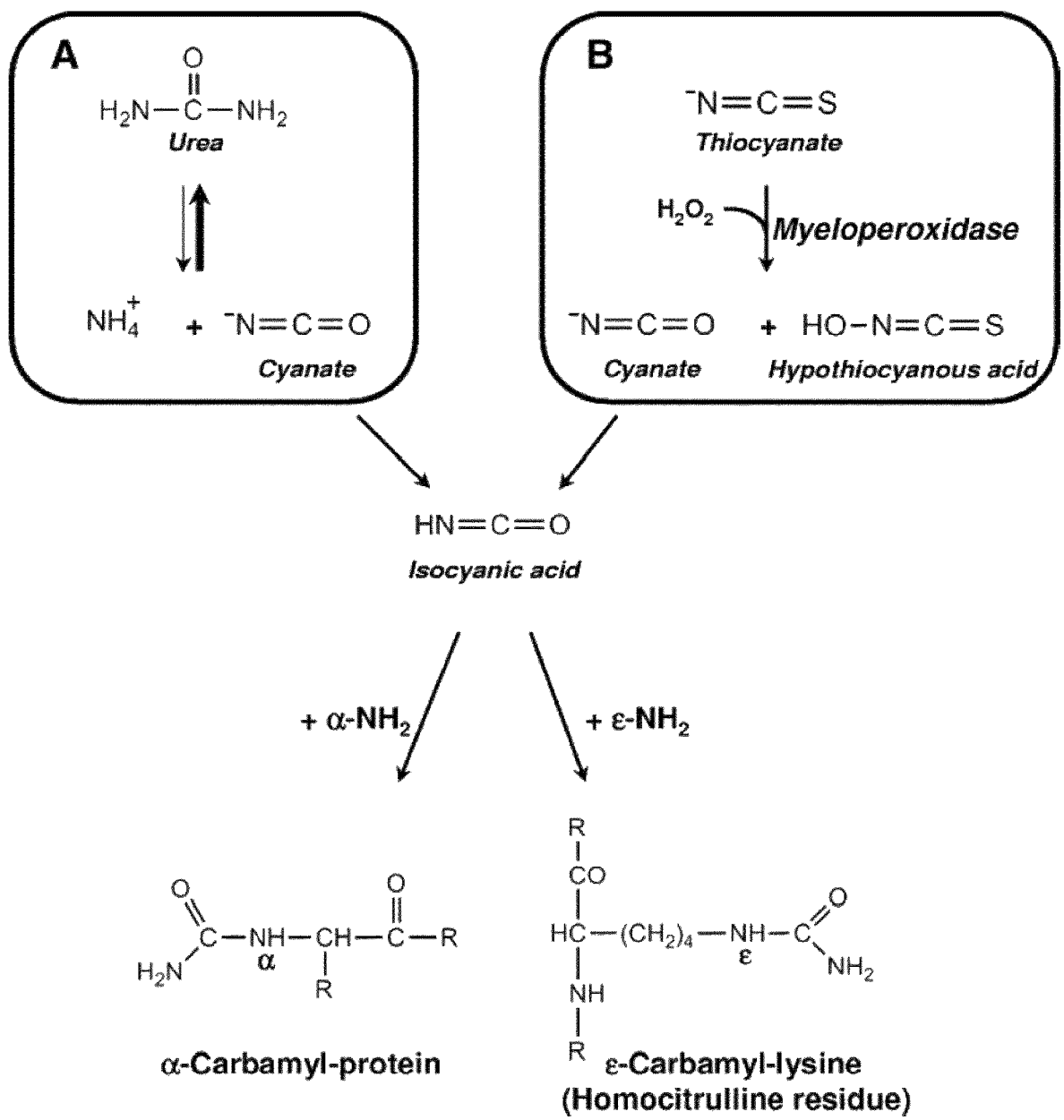

Specification includes a Sequence Listing.

(56) References Cited

FOREIGN PATENT DOCUMENTS

| WO | WO 2003/024191 A2 | 3/2003 |
|---|---|---|
| WO | WO 2003/084467 A2 | 10/2003 |
| WO | WO 2006/120474 A2 | 11/2006 |
| WO | WO 2007/000320 A2 | 1/2007 |
| WO | WO 2008/116937 A2 | 10/2008 |
| WO | WO 2010/117694 | 10/2010 |
| WO | WO 2012/095849 A1 | 7/2012 |
| WO | WO 2012/103365 A1 | 8/2012 |
| WO | WO 2012/138294 A1 | 10/2012 |
| WO | WO 2014/023957 A2 | 2/2014 |

OTHER PUBLICATIONS

Lugli, E. B. et al., "Expression of citrulline and homocitrulline residues in the lungs of non-smokers and smokers: implications for autoimmunity in rheumatoid arthritis", Arthritis Research & Therapy, vol. 17, No. 9, Jan. 20, 2015, 1-9.
Martinez, G. et al., "Carbamylated vimentin represents a relevant autoantigen in Latin American (Cuban) rheumatoid arthritis patients", Rheumatol. Int., Clinical and Experimental Investigations, vol. 36, No. 6, Apr. 2, 2016, 781-791.
Ospelt, C. et al., "Carbamylation of vimentin is inducible by smoking and represents an independent autoantigen in rheumatoid arthritis", Ann. Rheum. Dis., vol. 76, No. 7, Feb. 9, 2017, 1176-1183.
Communication pursuant to Article 94(3) EPC dated Jul. 19, 2017 for European Application No. 13 750 368.6.
Communication Under Rule 71(3) EPC dated Feb. 5, 2018 for European Application No. 13 750 368.6.
International Search Report and Written Opinion mailed Apr. 3, 2014 for International Application No. PCT/GB2013/052109.
International Preliminary Report on Patentability mailed Feb. 19, 2015 for International Application No. PCT/GB2013/052109.
[No Author Listed] Nice. Improving outcomes in colorectal cancers: Manual update. National Institute for Clinical Excellence, 2004.
Abdel-Fatah, T. et al. Are DNA Repair Factors Promising Biomarkers for Personalized Therapy in Gastric Cancer?. Antioxidants & Redox Signaling, vol. 18(18), 2013, 2392-2398.
Altschul et al., Basic Local Alignment Search Tool, J. Mol. Biol., 215, 1990, 403-410.
Altschul et al., Gapped BLAST and PSI-BLAST: a new generation of protein database search programs, Nucleic Acids Research, vol. 25, No. 17, 1997, 3389-3402.
Alvarez et al., Analysis of the HLA class I associated peptide repertoire in a hepatocellular carcinoma cell line reveals tumor-specific peptides as putative targets for immunotherapy. Proteomics Clinical Applications, 1 (3):286-298, 2007.
Andreasen, R. A. et al., "The plasminogen activation system in tumor growth, invasion, and metastasis", CMLS, Cell. Mol. Life Sci., 57, 2000, 25-40.
Arentz-Hansen et al. The intestinal T cell response to alpha-gliadin in adult celiac disease is focused on a single deamidated glutamine targeted by tissue transglutaminase. J Exp Med. Feb. 21, 2000;191(4):603-12. doi: 10.1084/jem.191.4.603.
Ausubel et al., Short protocols in molecular biology. John Wiley & Sons, 3rd Edition, 1992. p. 68.
Ayyoub et al., An immunodominant SSX-2-derived epitope recognized by CD4+ T cells in association with HLA-DR. J Clin Invest. Apr. 2004;113(8):1225-33. doi: 10.1172/JCI20667.
Baxevanis et al., Tumor-specific CD4+ T lymphocytes from cancer patients are required for optimal induction of cytotoxic T cells against the autologous tumor. J Immunol. Apr. 1, 2000;164(7):3902-12. doi: 10.4049/jimmunol.164.7.3902.
Brandmaier et al., High-avidity autoreactive CD4+ T cells induce host CTL, overcome T(regs) and mediate tumor destruction. J Immunother. Sep. 2009;32(7):677-88. doi: 10.1097/CJI.0b013e3181ab1824. Author Manuscript, 29 pages.
Bronte et al., Boosting antitumor responses of T lymphocytes infiltrating human prostate cancers. J Exp Med. Apr. 18, 2005;201(8):1257-68. doi: 10.1084/jem.20042028. Epub Apr. 11, 2005.
Camp et al., X-Tile: A New Bio-Informatics Tool for Biomarker Assessment and Outcome-Based Cut-Point Optimization. Clin Cancer Res. Nov. 1, 2004;10(21):7252-9. doi: 10.1158/1078-0432.
Cappello et al., Alpha-enolase: a promising therapeutic and diagnostic tumor Target. FEBS Journal, 278, 2011, 1064-1074.
Cappello et al., An integrated humoral and cellular response is elicited in pancreatic cancer by alpha-enolase, a novel pancreatic ductal adenocarcinoma-associated antigen. Int. J. Cancer:, 125, 2009, 639-648.
Cappello et al., Vaccination With ENO1 DNA Prolongs Survival of Genetically Engineered Mice With Pancreatic Cancer. Gastroenterology. May 2013;144(5):1098-106. doi: 10.1053/j.gastro.2013.01.020. Epub Jan. 16, 2013.
Cella et al., Ligation of CD40 on dendritic cells triggers production of high levels of interleukin-12 and enhances T cell stimulatory capacity: T-T help via APC activation. J Exp Med. Aug. 1, 1996;184(2):747-52. doi: 10.1084/jem.184.2.747.
Chang et al., Identification of Alpha-Enolase as an Autoantigen in Lung Cancer: Its Overexpression Is Associated with Clinical Outcomes. Clin Cancer Res., 12(19), Oct. 1, 2006, 5746-5754.
Chang et al., PADI4 and tumourigenesis. Cancer Cell International, 10:7-12, 2010.
Chang, X. et al., "Increased PADI4 expression in blood and tissues of patients with malignant tumors", BMC Cancer, 9:40, Jan. 30, 2009.
Choy, E., "Understanding the dynamics: pathways involved in the pathogenesis of rheumatoid arthritis", Rheumatology, 51, 2012, 1-9.
Coimbra et al., The roles of cells and cytokines in the pathogenesis of psoriasis. International Journal of Dermatology, 51, 2012, 389-398.
Conforti et al., Different vimentin expression in two clones derived from a human colocarcinoma cell line (LoVo) showing different sensitivity to doxorubicin. Br J Cancer. Mar. 1995;71(3):505-11. doi: 10.1038/bjc.1995.101.
De Ceuleneer et al., In vivo relevance of citrullinated proteins and the challenges in their detection. Proteomics, 12: 752-760. Mar. 2012. doi: 10.1002/pmic.201100478.
Diaz-Ramos et al., Alpha-Enolase, a Multifunctional Protein: Its Role on Pathophysiological Situations. Journal of Biomedicine and Biotechnology, 2012, 1-13.
Duncan et al., Loss of IFN gamma Receptor Is an Independent Prognostic Factor in Ovarian Cancer. Clin Cancer Res., 13(14), Jul. 15, 2007, 4139-4145.
Durrant et al., A New Anticancer Glycolipid Monoclonal Antibody, SC104, which Directly Induces Tumor Cell Apoptosis. Cancer Res., 66(11), Jun. 1, 2006, 5901-5909.
Fu et al., Alpha-enolase promotes cell glycolysis, growth, migration, and invasion in non-small cell lung cancer through FAK-mediated P13K/AKT pathway. Journal of Hematology & Oncology, 2015, 1-13.
Fuyuhiro et al., Clinical significance of vimentin-positive gastric cancer cells. Anticancer Res. Dec. 2010;30(12):5239-43.
Green et al., To Be or Not to Be?: How Selective Autophagy and Cell Death Govern Cell Fate. Cell, 157(1), Mar. 27, 2014, 65-75. Author Manuscript, 23 pages.
Grunewald et al., Role of CD4+ T Cells in Sarcoidosis. Proc Am Thorac Soc, vol. 4, 2007, 461-464.
Guo et al., Citrullination of inhibitor of growth 4 (ING4) by peptidylarginine deminase 4 (PAD4) disrupts the interaction between ING4 and p53. J Biol Chem. May 13, 2011;286(19):17069-78. doi: 10.1074/jbc.M111.230961. Epub Mar. 22, 2011.
Gustmann et al., Cytokeratin expression and vimentin content in large cell anaplastic lymphomas and other non-Hodgkin's lymphomas. Am J Pathol. Jun. 1991;138(6):1413-22.
Herzog et al., Activated antigen-presenting cells select and present chemically modified peptides recognized by unique CD4 T cells. Proc Natl Acad Sci U S A. May 31, 2005;102(22):7928-33. doi: 10.1073/pnas.0502255102. Epub May 18, 2005.

(56) References Cited

OTHER PUBLICATIONS

Hill et al., Cutting edge: the conversion of arginine to citrulline allows for a high-affinity peptide interaction with the rheumatoid arthritis-associated HLA-DRB1*0401 MHC class II molecule. J Immunol. Jul. 15, 2003;171(2):538-41. doi: 10.4049/jimmunol.171.2.538.

Holmdahl et al., T Lymphocytes in Collagen II-Induced Arthritis in Mice. Scand-J. Immunol., 22, 1985, 295-306.

Ireland et al., Autophagy in antigen-presenting cells results in presentation of citrullinated peptides to CD4 T cells. J Exp Med. Dec. 19, 2011;208(13):2625-32. doi: 10.1084/jem.20110640. Epub Dec. 12, 2011.Medicine, 2011, vol. 208 (13), 2625-2632.

Ireland et al., Cutting edge: unique T cells that recognize citrullinated peptides are a feature of protein immunization. J Immunol. Aug. 1, 2006;177(3):1421-5. doi: 10.4049/jimmunol.177.3.1421.

Ivaska, Vimentin: Central hub in EMT induction? Small GTPases. Jan. 2011;2(1):51-53. doi: 10.4161/sgtp.2.1.15114.

Jang et al., Accumulation of Citrullinated Proteins by Up-Regulated Peptidylarginine Deiminase 2 in Brains of Scrapie-Infected Mice. The American Journal of Pathology, vol. 173, No. 4, Oct. 2008, 1129-1142.

Jang et al., Involvement of peptidylarginine deiminase-mediated post-translational citrullination in pathogenesis of sporadic Creutzfeldt-Jakob disease. Acta Neuropathol, 119, 2010, 199-210.

Jang et al., Peptidylarginine deiminase modulates the physiological roles of enolase via citrullination: links between altered multifunction of enolase and neurodegenerative diseases. Biochem. J., 445, 2012, 183-192.

Karlin et al., Applications and statistics for multiple high-scoring segments in molecular sequences. Proc Natl Acad Sci U S A. Jun. 15, 1993;90(12):5873-7. doi:10.1073/pnas.90.12.5873.

Kaufmann, The contribution of immunology to the rational design of novel antibacterial vaccines. Nat Rev Microbiol. Jul. 2007;5(7):491-504. doi: 10.1038/nrmicro1688.

Kinloch et al., Identification of citrullinated alpha-enolase as a candidate autoantigen in rheumatoid arthritis. Arthritis Research & Therapy. vol. 7 No. 6, Oct. 19, 2005, 1-9.

Kinloch et al., Synovial Fluid Is a Site of Citrullination of Autoantigens in Inflammatory Arthritis. Arthritis & Rheumatism. vol. 58, No. 8, Aug. 2008, 2287-2295.

Klareskog et al. Immunity to citrullinated proteins in rheumatoid arthritis. Annu Rev Immunol. 2008;26:651-75. doi: 10.1146/annurev.immunol.26.021607.090244.

Kondo et al., Natural Antigenic Peptides from Squamous Cell Carcinoma Recognized by Autologous HLA-DR8-restricted CD4+ T Cells. Jpn. J. Cancer Res., 93, Aug. 2002, 917-924.

Lauwen et al., Self-tolerance does not restrict the CD4+ T-helper response against the p53 tumor antigen. Cancer Res. Feb. 1, 2008;68(3):893-900. doi: 10.1158/0008-5472.CAN-07-3166.

Law et al. T-cell autoreactivity to citrullinated autoantigenic peptides in rheumatoid arthritis patients carrying HLA-DRB1 shared epitope alleles. Arthritis Res Ther. May 17, 2012;14(3):R118. doi: 10.1186/ar3848.

Livesey et al., p53/HMGB1 complexes regulate autophagy and apoptosis. Cancer Res. Apr. 15, 2012;72(8):1996-2005. doi: 10.1158/0008-5472.CAN-11-2291. Epub Feb. 16, 2012.

Loos et al., Citrullination of CXCL10 and CXCL11 by peptidylarginine deiminase: a naturally occurring posttranslational modification of chemokines and new dimension of immunoregulation. Blood. Oct. 1, 2008;112(7):2648-56. doi: 10.1182/blood-2008-04-149039. Epub Jul. 21, 2008.

Lundberg et al. Citrullinated proteins have increased immunogenicity and arthritogenicity and their presence in arthritic joints correlates with disease severity. Arthritis Res Ther. 2005;7(3):R458-67. doi: 10.1186/ar1697. Epub Feb. 21, 2005.

Lundberg et al., Antibodies to citrullinated alpha-enolase peptide 1 are specific for rheumatoid arthritis and cross-react with bacterial enolase. Arthritis & Rheumatism. Oct. 1, 2008. 58(10):3009-3019.

Mahdi et al., Specific interaction between genotype, smoking and autoimmunity to citrullinated alpha-enolase in the etiology of rheumatoid arthritis. Nature Genetics, Dec. 2009, 41(12):1319-1327.

Marangos et al., Neuronal, Non-Neuronal And Hybrid Forms Of Enolase In Brain: Structural, Immunological And Functional Comparisons. Brain Research, 150, 1978, 117-133.

Metheringham et al., Antibodies designed as effective cancer vaccines. MAbs. Jan.-Feb. 2009;1(1):71-85. doi: 10.4161/mabs.1.1.7492.

Miles et al., Role of Cell-Surface Lysines in Plasminogen Binding to Cells: Identification of alpha-Enolase as a Candidate Plasminogen Receptor. Biochemistry, 30, 1991, 1682-1691.

Mohanan et al., Potential role of peptidylarginine deiminase enzymes and protein citrullination in cancer pathogenesis. Biochem Res Int. 2012;2012:895343. doi: 10.1155/2012/895343. Epub Sep. 16, 2012.

Munz, C., "Antigen processing for MHC class II presentation via autophagy", Frontiers in Immunology, vol. 3, Art. 9, Feb. 2, 2012, 1-6.

Muranski et al., Tumor-specific Th17-polarized cells eradicate large established melanoma. Blood. Jul. 15, 2008;112(2):362-73. doi: 10.1182/blood-2007-11-120998. Epub Mar. 19, 2008.

Myers et al., Approximate Matching Of Regular Expressions. Bulletin of Mathematical Biology vol. 51, No. 1, 1989, 5-37.

Nakamura et al., Disruption of a Spermatogenic Cell-Specific Mouse Enolase 4 (Eno4) Gene Causes Sperm Structural Defects and Male Infertility. Biology Of Reproduction. 88(4)90, 2013, 1-12.

Ordonez et al., Increased levels of citrullinated antithrombin in plasma of patients with rheumatoid arthritis and colorectal adenocarcinoma determined by a newly developed ELISA using a specific monoclonal antibody. Thrombosis and Haemostasis, 104(6):1143-1149, 2010.

Palena et al., Strategies to target molecules that control the acquisition of a mesenchymal-like phenotype by carcinoma cells. Exp Biol Med (Maywood). May 1, 2011;236(5):537-45. doi: 10.1258/ebm.2011.010367. Epub Mar. 22, 2011. Author Manuscript, 19 pages.

Paludan et al., Epstein-Barr nuclear antigen 1-specific CD4(+) Th1 cells kill Burkitt's lymphoma cells. J Immunol. Aug. 1, 2002;169(3):1593-603. doi: 10.4049/jimmunol.169.3.1593.

Pancholi, Multifunctional alpha-enolase: its role in diseases. CMLS, Cell. Mol. Life Sci. 58, 2001, 902-920.

Pardoll et al., The role of CD4+ T cell responses in antitumor immunity. Curr Opin Immunol. Oct. 1998;10(5):588-94. doi: 10.1016/s0952-7915(98)80228-8.

Pearson et al., Improved tools for biological sequence comparison. Proc Natl Acad Sci U S A. Apr. 1988;85(8):2444-8. doi: 10.1073/pnas.85.8.2444.

Pluckthun, Antibody engineering: advances from the use of *Escherichia coli* expression systems. Biotechnology (N Y). Jun. 1991;9(6):545-51. doi: 10.1038/nbt0691-545.

Principe et al., Targeting of surface alpha-Enolase inhibits the invasiveness of pancreatic cancer cells. Oncotarget, Advance Publications online at www.impactjournals.com/oncotarget/, 2015, 1-16.

Proost et al., Citrullination of CXCL8 by peptidylarginine deiminase alters receptor usage, prevents proteolysis, and dampens tissue inflammation. J Exp Med. Sep. 1, 2008;205(9):2085-97. doi: 10.1084/jem.20080305. Epub Aug. 18, 2008.

Pudney et al., DNA vaccination with T-cell epitopes encoded within Ab molecules induces high-avidity anti-tumor CD8+ T cells. Eur J Immunol. Mar. 2010;40(3):899-910. doi: 10.1002/eji.200939857.

Quezada et al., Tumor-reactive CD4(+) T cells develop cytotoxic activity and eradicate large established melanoma after transfer into lymphopenic hosts. J Exp Med. Mar. 15, 2010;207(3):637-50. doi: 10.1084/jem.20091918. Epub Feb. 15, 2010.

Reff, High-level production of recombinant immunoglobulins in mammalian Cells. Current Opinion in Biotechnology, 4, 1993, 573-576.

Romani et al., Targeting Skin Dendritic Cells to Improve Intradermal Vaccination. Current topics in microbiology and immunology, 351, 2012, 113-138.

(56) References Cited

OTHER PUBLICATIONS

Rosenfeldt et al., The role of autophagy in tumour development and cancer therapy. Expert Rev Mol Med. Dec. 2, 2009;11:e36. doi: 10.1017/S1462399409001306.

Schellekens et al., Citrulline is an Essential Constituent of Antigenic Determinants Recognized by Rheumatoid Arthritis-specific Autoantibodies. J. Clin. Invest., vol. 101, No. 1, Jan. 1998, 273-281.

Schmid et al., MHC class II antigen loading compartments continuously receive input from autophagosomes. Immunity, 26(1 ), Jan. 2007, 79-92 (1-29). Author Manuscript, 29 pages.

Sebbag et al. Epitopes of human fibrin recognized by the rheumatoid arthritis-specific autoantibodies to citrullinated proteins. Eur J Immunol. Aug. 2006;36(8):2250-63. doi: 10.1002/eji.200535790.

Semenza et al., Hypoxia Response Elements in the Aldolase A, Enolase 1, and Lactate Dehydrogenase A Gene Promoters Contain Essential Binding Sites for Hypoxia-inducible Factor 1. J. Bio. Chem., vol. 271, No. 51, Dec. 20, 1996, 32529-32537.

Simpson et al., Intratumoral T cell infiltration, MHC class I and STAT1 as biomarkers of good prognosis in colorectal cancer. Gut, 59, 2010, 926-933.

Storr et al., Calpain system protein expression in carcinomas of the pancreas, bile duct and ampulla. BMC Cancer, 12, online http://www.biomedcentral.com/1471-2407/12/511, 2012, 511 (1-9).

Struyf et al., Citrullination of CXCL12 differentially reduces CXCR4 and CXCR7 binding with loss of inflammatory and anti-HIV-1 activity via CXCR4. J Immunol. Jan. 1, 2009;182(1):666-74. doi: 10.4049/jimmunol.182.1.666.

Torelli et al., ADVANCE and ADAM: two algorithms for the analysis of global similarity between homologous informational sequences. CABIOS, vol. 10, No. 1, 1994, 3-5.

Touloukian, et al. Identification of a MHC class II-restricted human gp100 epitope using DR4-IE transgenic mice. J Immunol. Apr. 1, 2000;164(7):3535-42. doi: 10.4049/jimmunol.164.7.3535. Author Manuscript, 19 pages.

Trill et al., Production of monoclonal antibodies in COS and CHO cells. Current Opinion in Biotechnology, 6, 1995, 553-560.

Uysal et al., Antibodies to citrullinated proteins: molecular interactions and arthritogenicity. Immunol Rev. Jan. 2010;233(1):9-33. doi: 10.1111/j.0105-2896.2009.00853.x.

Vossenaar et al. Rheumatoid arthritis specific anti-Sa antibodies target citrullinated vimentin. Arthritis Res Ther. 2004;6(2):R142-50. doi: 10.1186/ar1149. Epub Feb. 5, 2004.

Vossenaar et al., Expression and activity of citrullinating peptidylarginine deiminase enzymes in monocytes and macrophages. Ann Rheum Dis. Apr. 2004;63(4):373-81. doi: 10.1136/ard.2003.012211.

Williams et al., CD 9 and vimentin distinguish clear cell from chromophobe renal cell carcinoma. BMC Clin Pathol. Nov. 18, 2009;9:9. doi: 10.1186/1472-6890-9-9.

Xie et al., Naive tumor-specific CD4(+) T cells differentiated in vivo eradicate established melanoma. J Exp Med. Mar. 15, 2010;207(3):651-67. doi: 10.1084/jem.20091921. Epub Feb. 15, 2010.

Zhao et al., Enolase-1 is a therapeutic target in endometrial carcinoma. Oncotarget, Advance Publications, on line at www.impactjournals.com/oncotarget/, 2015, 1-18.

English Translation, Japanese Office Action for 2021-514340, dated Aug. 8, 2023.

Durrant, L. G, et al., "Autophagy, citrullination and cancer", Autophagy, 12, 2016, 1055-1056.

Deraos et al., Citrullination of linear and cyclic altered peptide ligands from myelin basic protein (MBP(87-99)) epitope elicits a Th1 polarized response by T cells isolated from multiple sclerosis patients: implications in triggering disease. J Med Chem. Dec. 25, 2008;51(24):7834-42. doi: 10.1021/jm800891n.

Ireland et al., Processing of proteins in autophagy vesicles of antigen-presenting cells generates citrullinated peptides recognized by the immune system. Autophagy. Mar. 2012;8(3):429-30. doi: 10.4161/auto.19261. Epub Feb. 24, 2012.

Ossendorp et al., Specific T helper cell requirement for optimal induction of cytotoxic T lymphocytes against major histocompatibility complex class II negative tumors. J Exp Med. Mar. 2, 1998;187(5):693-702. doi: 10.1084/jem.187.5.693.

Romani et al., Targeting of antigens to skin dendritic cells: possibilities to enhance vaccine efficacy. Immunol Cell Biol. May-Jun. 2010;88(4):424-30. doi: 10.1038/icb.2010.39. Epub Apr. 6, 2010. Author Manuscript, 16 pages.

Snir et al., Identification and functional characterization of T cells reactive to citrullinated vimentin in HLA-DRB1*0401-positive humanized mice and rheumatoid arthritis patients. Arthritis Rheum. Oct. 2011;63(10):2873-83. doi: 10.1002/art.30445. Author Manuscript, 16 pages.

Wang et al., Approaches to improved targeting of DNA vaccines. Hum Vaccin. Dec. 2011;7(12):1271-81. doi: 10.4161/hv.7.12. 17983. Epub Dec. 1, 2011.

\* cited by examiner

Figure 2a Sequence logo representation of the binding motifs for 6 HLA-DR molecules using NNAlign
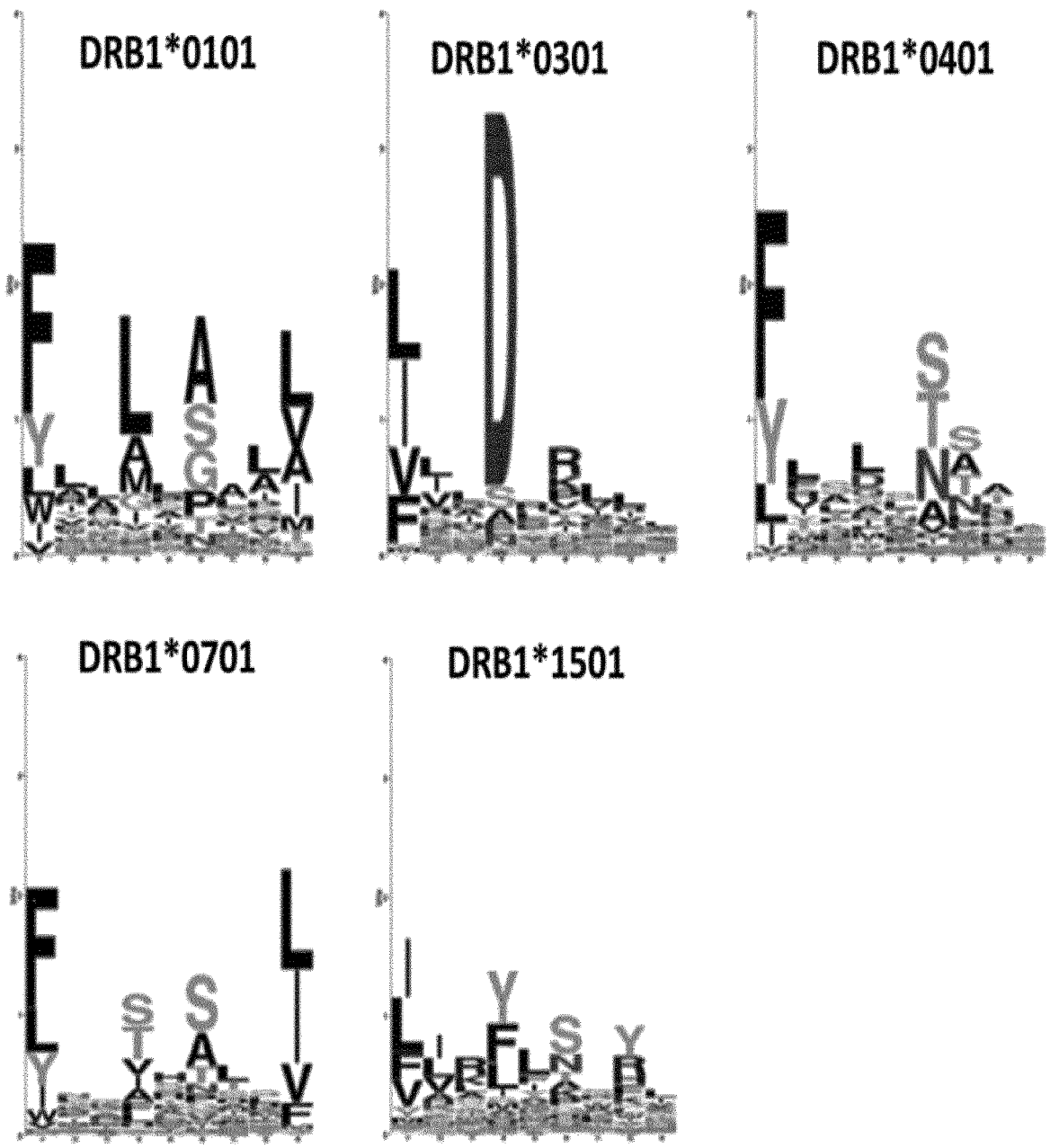

Figure 2b Sequence logo representation of the binding motifs for 5 HLA-A molecules using NetMHCpan
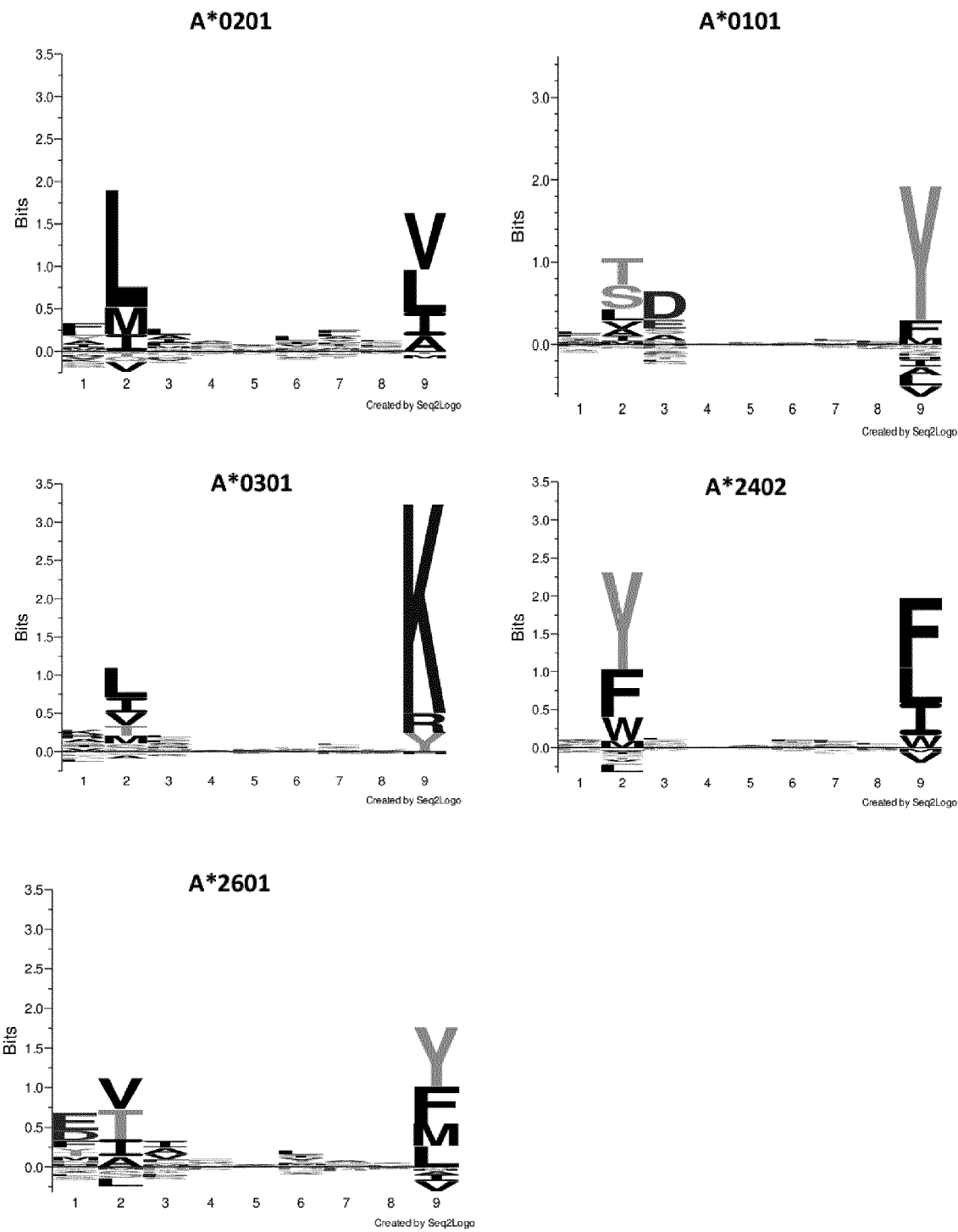

Figure 2c Sequence logo representation of the binding motifs for 4 HLA-B molecules using NetMHCpan
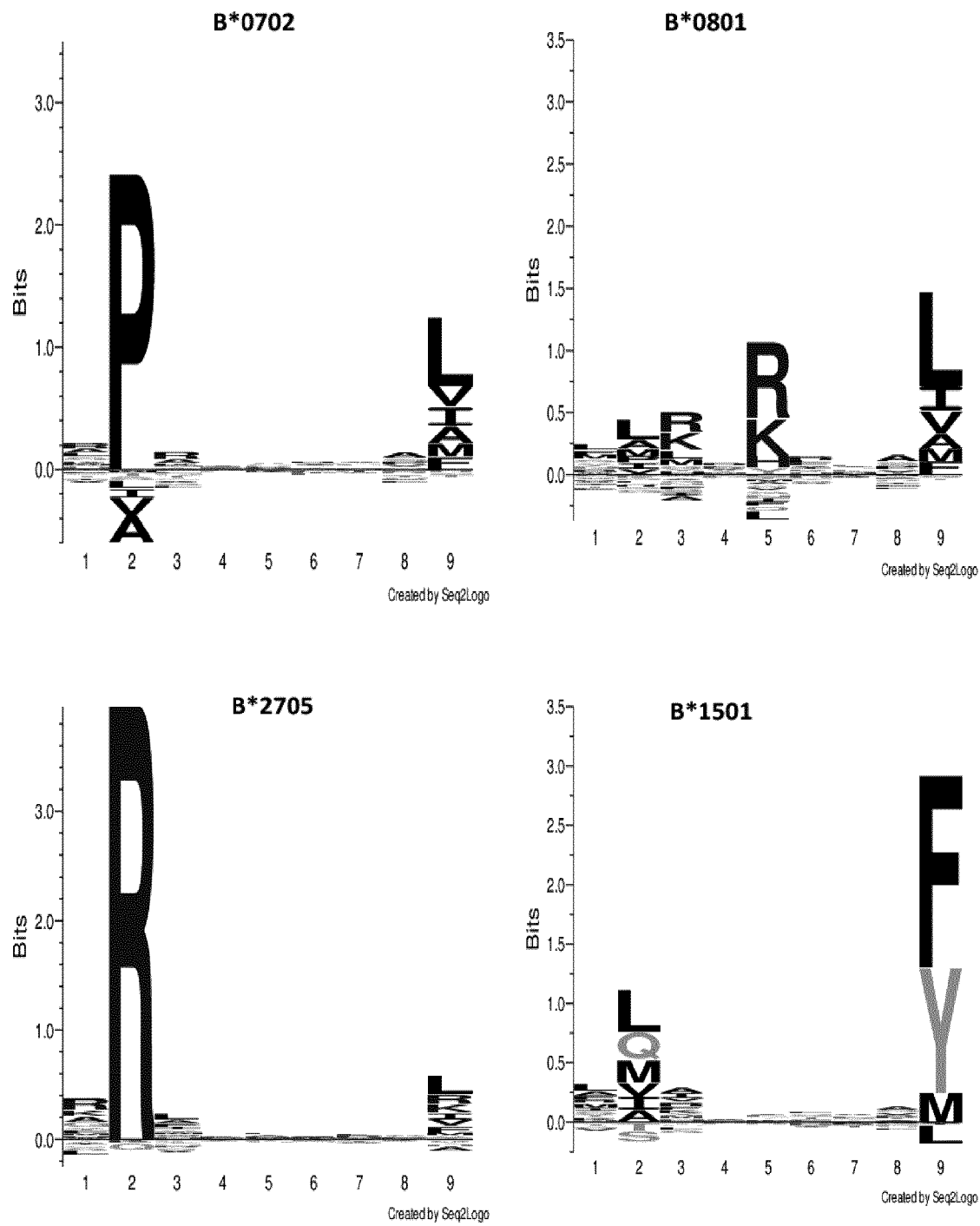

Figure 3A Homology of Human Aldolase A with B and C

```
                      1                                                                        70
ALDOA_HUMAN P04075  (1) MPYQYPALTPEQKKELSDIAHRIVAPGKGILAADESTGSIAKRLQSIGTENTEENRRFYRQLLLTADDRV
ALDOB_HUMAN P05062  (1) MAHRFPALTQEQKKELSEIAQSIVANGKGILAADESVGTMGNRLQRIKVENTEENRRQFREILFSVDSSI
ALDOC_HUMAN P09972  (1) MPHSYPALSAEQKKELSDIALRIVAPGKGILAADESVGSMAKRLSQIGVENTEENRRELYRQVLFSADDSV
         Consensus  (1) MP  YPALT EQKKELSDIA RIVAPGKGILAADESVGSMAKRLQ IGVENTEENRR YRQILFSADDSV
                     71                                                                       140
ALDOA_HUMAN P04075 (71) NPCIGGVILFHETLYQKADDGRPFPQVIKSKGGVVGIKVDKGVVPLAGTNGETTTQGLDGLSERCAQYKK
ALDOB_HUMAN P05062 (71) NQSIGGVILFHETLYQKDSQGKLFRNILKEKGIVVGIKLDQGGAPLAGTNKETTIQGLDGLSERCAQYKK
ALDOC_HUMAN P09972 (71) RKCIGGVIFFHETLYQKDDNGVPFVRTIQDKGIVVGIKVDKGVVPLAGTDGETTTQGLDGLSERCAQYKK
         Consensus (71) N CIGGVILFHETLYQKDDNGKPF NIIKDKGIVVGIKVDKGVVPLAGTNGETTTQGLDGLSERCAQYKK
                    141                                                                       210
ALDOA_HUMAN P04075(141) DGADFAKWRCVLKIGEHTPSALAIMENANVLARYASICQQNGIVPIVEPEILPDGDHDLKRCQYVTEKVL
ALDOB_HUMAN P05062(141) DGVDFGKWRAVLPITADQCPSSLAIQENANALARYASICQQNGLVPIVEPEVLPDGDHDLEHCQYVTEKVL
ALDOC_HUMAN P09972(141) DGADFAKWRCVLKISERTPSALAILENANVLARYASICQQNGIVPIVEPEILPDGDHDLKRCQYVTEKVL
         Consensus(141) DGADFAKWRCVLKIAE TPSALAILENANVLARYASICQQNGIVPIVEPEILPDGDHDLKRCQYVTEKVL
                    211                                                                       280
ALDOA_HUMAN P04075(211) AAVYKALSDHHIYLEGTLLKPNMVTPGHACTQKFSHEEIAMATVTALRRTVPPAVTGITFLSGGQSEEEA
ALDOB_HUMAN P05062(211) AAVYKALSDHHVYLEGTLLKPNMVTAGHACTKKYTPEQVAMATVTALRRTVPAAVPGICFLSGGMSEEDA
ALDOC_HUMAN P09972(211) AAVYKALSDHHVYLEGTLLKPNMVTPGHACPIKYTPEEIAMATVTALRRTVPPAVPGVTFLSGGQSEEEA
         Consensus(211) AAVYKALSDHHVYLEGTLLKPNMVTPGHACT KYTPEEIAMATVTALRRTVPPAVPGITFLSGGQSEEEA
                    281                                                                       350
ALDOA_HUMAN P04075(281) SINLNAINKCPLLKPWALTFSYGRALQASALKAWGGKKENLKAAQEEYVKRALANSLACQGKYTPSGQAG
ALDOB_HUMAN P05062(281) TLNLNAIKKLCPLPEPWKLSFSYGRALQASALKAWGGKKAANKEATQEAFMKRAMANCQAAKGQYVHTGSSG
ALDOC_HUMAN P09972(281) SPNLNAINRCPLPRPWALTFSYGRALQASALNAWPGQRDNAGAATEEFIKRAEVNGLAAQGKYEGSGEDG
         Consensus(281) SINLNAINRCPL PPWALTFSYGRALQASAL AWGGKKDN AAQEEFIKRALAN LAAQGKY SG AG
                    351        364
ALDOA_HUMAN P04075(351) AAASESLFVSNHAY(SEQ ID NO: 519)
ALDOB_HUMAN P05062(351) AASTQSLFTACYTY(SEQ ID NO: 520)
ALDOC_HUMAN P09972(351) GAAAQSLYIANHAY(SEQ ID NO: 813)
         Consensus(351) AAASQSLFIANHAY(SEQ ID NO: 522)
```

Figure 3B Amino Acid Sequence of Human Aldolase A (Accession Number P04075)

```
  1 MPYQYPALTP EQKKELSDIA HRIVAPGKGI LAADESTGSI AKRLQSIGTE NTEENRRFYR QLLLTADDRV
 71 NPCIGGVILF HETLYQKADD GRPFPQVIKS KGGVVGIKVD KGVVPLAGTN GETTTQGLDG LSEPCAQYKK
141 DGADFAKWRC VLKIGEHTPS ALAIMENANV LARYASICQQ NGIVPIVEPE ILPDGDHDLK PCQYVTEKVL
211 AAVYKALSDH HIYLEGTLLK PNMVTPGHAC TQKFSHEEIA MATVTALSRT VPPAVTGITF LSGGQSEEEA
281 SINLNAINKC FLLKPWALTF SYGRALQASA LKAWGGKKEN LKAAQEEYVK RALANSLACQ GKYTPSGQAG
351 AAASESLFVS NHAY(SEQ ID NO: 519)
```

Figure 3C Amino Acid Sequence of Human Vimentin (Accession Number P08670)

```
  1 MSTRSVSSSS YRRMFGGPGT ASRPSSSRSY VTTSTRTYSL GSALRPSTSR SLYASSPGGV YATPSSAVRL
 71 RSSVPGVRLL QDSVDFSLAD AINTEFKNTR TNEKVELQEL NDRFANYIDK VRFLEQQNKI LLAELEQLKG
141 QGKSRLGDLY EEEMRELRRQ VDQLTNDKAR VEVERDNLAE DIMRLREKLQ EEMLQREEAE NTLQSFRQDV
211 DNASLARLDL ERKVESLQEE IAFLKKLHEE EIQELQAQIQ EQHVQIDVDV SKPDLTAALR DVRQQYESVA
281 AKNLQEAEEW YKSKFADLSE AANRNNDALR QAKQESTEYR RQVQSLTCEV DALKGTNESL ERQMREMEEN
351 FAVEAANYQD TIGRLQDEIQ NMKEEMARHL REYQDLLNVK MALDIEIATY RKLLEGEESR ISLPLPNFSS
421 LNLRETNLDS LPLVDTHSKR TLLIKTVETR DGQVINETSQ HHDDLE(SEQ ID NO: 523)
```

Figure 3D Amino Acid Sequence of Human Cytokeratin 8 (Accession Number P05787)

```
  1 MSIRVTQKSY KVSTSGPRAF SSRSYTSGPG SRISSSSFSR VGSSNFRGGL GGGYGGASGM GGITAVTVNQ
 71 SLLSPLVLEV DPNIQAVRTQ EKEQIKTLNN KFASFIDKVR FLEQQNKMLE TKWSLLQQQK TARSNMDNMF
141 ESYINNLRRQ LETLGQEKLK LEAELGNMQG LVEDFKNKYE DEINKRTEME FLVLRKQV QEAYMNKVEL
211 ESRLEGLTDE INFLRQLYEE EIRELQSQIS DTSVVLSMDN SRSLDMDSII AEVKAQYEDI ANRSRAEAES
281 MYQIKYEELQ SLAGKHGDDL RRTKTEISEM NRNISRLQAE IEGLKGQRAS LEAAIADAEQ RGELAIKDAN
351 AKLSELEAAL QRAKQDMAPQ LREYQELMNV KLALDIEIAT YRKLLEGEES RLESGMQNMS IHTKTTSGYA
421 GGLSSAYGGL TSGLGSYSLG SSFGSGAGSS SFSRTSSSRA VVVKKIETRD GKLVSESSDV LPK(SEQ ID NO: 524)
```

Figure 3E Amino Acid Sequence of Human BIP (Accession Number P11021)

```
  1  MKLSLVAAML LLLSAARAEE EDKKEDVGTV VGIDLGTTYS CVGVFKNGRV EIIANDQGNR ITPSYVAFTP
 71  EGERLIGDAA KNQLTSNPEN TVFDAKRLIG RTWNDPSVQQ DIKFLPFKVV EKKTKPYIQV DIGGGQTKTF
141  APEEISAMVL TKMKETAEAY LGKKVTHAVV TVPAYFNDAQ RQATKDAGTI AGLNVMRIIN EPTAAAIAYG
211  LDKREGEKNI LVFDLGGGTF DVSLLTIDNG VFEVVATNGD THLGGEDFDQ RVMEHFIKLY KKKTGKDVRK
281  DNRAVQKLRR EVEKAKRALS SQHQARIEIE SFYEGEDFSE TLTRAKFEEL NMDLFRSTMK PVQKVLEDSD
351  LKKSDIDEIV LVGGSTRIPK IQQLVKEFFN GKEPSRGINP DEAVAYGAAV QAGVLSGDQD TGDLVLLDVC
421  PLTLGIETVG GVMTKLIPRN TVVPTKKSQI FSTASDNQPT VTIKVYEGER PLTKDNHLLG TFDLTGIPPA
491  PRGVPQIEVT FEIDVNGILR VTAEDKGTGN KNKITITNDQ NRLTPEEIER MVNDAEKFAE EDKKLKERID
561  TRNELESYAY SLKNQIGDKE KLGGKLSSED KETMEKAVEE KIEWLESHQD ADIEDFKAKK KELEEIVQPI
631  ISKLYGSAGP PPTGEEDTAE KDEL(SEQ ID NO: 525)
```

Figure 3F Amino Acid Sequence of Human Nucleophosmin (Accession Number P06748)

```
  1  MEDSMDMDMS PLRPQNYLFG CELKADKDYH FKVDNDENEH QLSLRTVSLG AGAKDELHIV EAEAMNYEGS
 71  PIKVTLATLK MSVQPTVSLG GFEITPPVVL RLKCGSGPVH ISGQHLVAVE EDAESEDEEE EDVKLLSISG
141  KRSAPGGGSK VPQKKVKLAA DEDDDDDDEE DDEDDDDDDD EDDEEAEEKA PVKKSIRDTP AKNAQKSNQN
211  GKDSKPSSTP RSKGQESFKK QEKTPKTPKG PSSVEDIKAK MQASIEKGGS LPKVEAKFIN YVKNCFRMTD
281  QEAIQDLWQW RKSL(SEQ ID NO: 526)
```

Figure 3G Amino Acid Sequence of Human Alpha Enolase (Accession Number P06733)

```
  1  MSILKIHARE IFDSRGNPTV EVDLFTSKGL FRAAVPSGAS TGIYEALELR DNDKTRYMGK GVSKAVEHIN
 71  KTIAPALVSK KLNVTEQEKI DKLMIEMDGT ENKSKFGANA ILGVSLAVCK AGAVEKGVPL YRHIADLAGN
141  SEVILPVPAF NVINGGSHAG NKLAMQEFMI LPVGAANFRE AMRIGAEVYH NLKNVIKEKY GKDATNVGDE
211  GGFAPNILEN KEGLELLKTA IGKAGYTDKV VIGMDVAASE FFRSGKYDLD FKSPDDPSRY ISPDQLADLY
281  KSFIKDYPVV SIEDPFDQDD WGAWQKFTAS AGIQVVGDDL TVTNPKRIAK AVNEKSCNCL LLKVNQIGSV
351  TESLQACKLA QANGWGVMVS HRSGETEDTF IADLVVGLCT GQIKTGAPCR SERLAKYNQL LRIEEELGSK
421  AKFAGRNFRN PLAK(SEQ ID NO: 527)
```

Figure 3H Amino Acid Sequence of Human β Catenin (Accession Number P35222)

```
  1  MATQADLMEL DMAMEPDRKA AVSHWQQQSY LDSGIHSGAT TTAPSLSGKG NPEEEDVDTS QVLYEWEQGF
 71  SQSFTQEQVA DIDGQYAMTR AQRVRAAMFP ETLDEGMQIP STQFDAAHPT NVQRLAEPSQ MLKHAVVNLI
141  NYQDDAELAT RAIPELTKLL NDEDQVVVNK AAVMVHQLSK KEASRHAIMR SPQMVSAIVR TMQNTNDVET
211  ARCTAGTLHN LSHHREGLLA IFKSGGIPAL VKMLGSPVDS VLFYAITTLH NLLLHQEGAK MAVRLAGGLQ
281  KMVALLNKTN VKFLAITTDC LQILAYGNQE SKLIILASGG PQALVNIMRT YTYEKLLWTT SRVLKVLSVC
351  SSNKPAIVEA GGMQALGLHL TDPSQRLVQN CLWTLRNLSD AATKQEGMEG LLGTLVQLLG SDDINVVTCA
421  AGILSNLTCN NYKNKMMVCQ VGGIEALVRT VLRAGDREDI TEPAICALRH LTSRHQEAEM AQNAVRLHYG
491  LPVVVKLLHP PSHWPLIKAT VGLIRNLALC PANHAPLREQ GAIPRLVQLL VRAHQDTQRR TSMGGTQQQF
561  VEGVRMEEIV EGCTGALHIL ARDVHNRIVI RGLNTIPLFV QLLYSPIENI QRVAAGVLCE LAQDKEAAEA
631  IEAEGATAPL TELLHSSNEG VATYAAAVLF RMSEDKPQDY KKRLSVELTS SLFRTEPMAW NETADLGLDI
701  GAQGEPLGYR QDDPSYRSFH SGGYGQDALG MDPMMEHEMG GHHPGADYPV DGLPDLGHAQ DLMDGLPPGD
771  SNQLAWFDTD L(SEQ ID NO: 528)
```

Figure 3I Amino Acid Sequence of Human Heat Shock Protein 60 (Accession Number P10809)

```
  1  MLRLPTVFRQ MRPVSRVLAP HLTRAYAKDV KFGADARALM LQGVDLLADA VAVTMGPKGR TVIIEQSWGS
 71  PKVTKDGVTV AKSIDLKDKY KNIGAKLVQD VANNTNEEAG DGTTTATVLA RSIAKEGFEK ISKGANPVEI
141  RRGVMLAVDA VIAELKKQSK PVTTPEEIAQ VATISANGDK EIGNIISDAM KKVGRKGVIT VKDGKTLNDE
211  LEIIEGMKFD RGYISPYFIN TSKGQKCEFQ DAYVLLSEKK ISSIQSIVPA LEIANAHRKP LVIIAEDVDG
281  EALSTLVLNR LKVGLQVVAV KAPGFGDNRK NQLKDMAIAT GGAVFGEEGL TLNLEDVQPH DLGKVGEVIV
351  TKDDAMLLKG KGDKAQIEKR IQEIIEQLDV TTSEYEKEKL NERLAKLSDG VAVLKVGGTS DVEVNEKKDR
421  VTDALNATRA AVEEGIVLGG GCALLRCIPA LDSLTPANED QKIGIEIIKR TLKIPAMTIA KNAGVEGSLI
491  VEKIMQSSSE VGYDAMAGDF VNMVEKGIID PTKVVRTALL DAAGVASLLT TAEVVVTEIP KEEKDPGMGA
561  MGGMGGGMGG GMF(SEQ ID NO: 529)
```

Figure 6
a
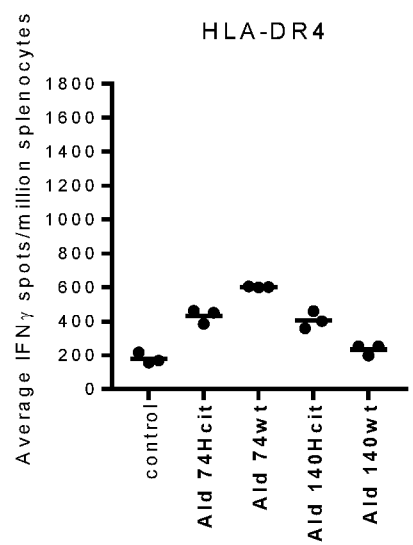
b
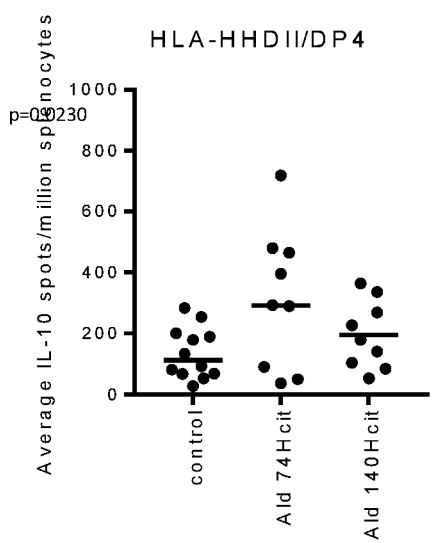
c
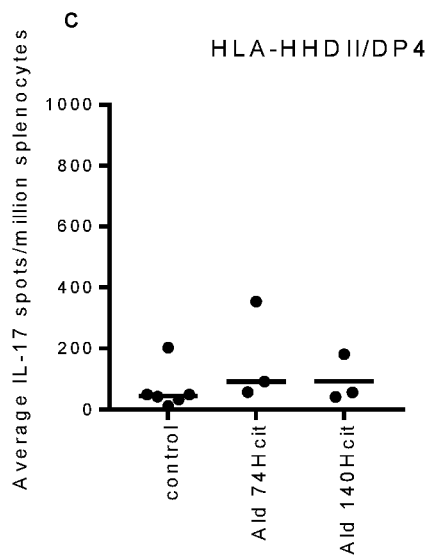

Figure 8a

```
                                         86                  108
            VIMENTIN_HUMAN    (86)  FSLADAINTEFKNTRTNEKVELQ (SEQ ID NO: 13)
                VIME_MOUSE    (86)  FSLADAINTEFKNTRTNEKVELQ (SEQ ID NO: 814)
                VIME_BOVIN    (86)  FSLADAINTEFKNTRTNEKVELQ (SEQ ID NO: 815)
                  VIME_PIG    (86)  FSLADAINTEFRNTRTNEKVELQ (SEQ ID NO: 816)
   VIMENTIN HORSE NP_001230074 (86) FSLADAINTEFKNTRTNEKVELQ (SEQ ID NO: 817)
 VIMENTIN CHICKEN NP_001041541 (80) FTLADAINTEFKANRTNEKVELQ (SEQ ID NO: 531)
        VIME SHEEP ABP48145   (86)  FSLADAINTEFKNTRTNEKVELQ (SEQ ID NO: 618)
                VIMENTIN DOG  (86)  FSLADAINTEFKNTRTNEKVELQ (SEQ ID NO: 819)
   VIME RABBIT XP_002717466   (86)  FSLADAINTEFRNTRTNEKVELQ (SEQ ID NO: 820)
                 Consensus    (86)  FSLADAINTEFKNTRTNEKVELQ (SEQ ID NO: 821)

96            115
            VIMENTIN_HUMAN    (96)  FKNTRTNEKVELQELNDRFA (SEQ ID NO: 8)
                VIME_MOUSE    (96)  FKNTRTNEKVELQELNDRFA (SEQ ID NO: 822)
                VIME_BOVIN    (96)  FKNTRTNEKVELQELNDRFA (SEQ ID NO: 823)
                  VIME_PIG    (96)  FKNTRTNEKVELQELNDRFA (SEQ ID NO: 824)
   VIMENTIN HORSE NP_001230074 (96) FKNTRTNEKVELQELNDRFA (SEQ ID NO: 825)
 VIMENTIN CHICKEN NP_001041541 (90) FKANRTNEKVELQELNDRFA (SEQ ID NO: 532)
        VIME SHEEP ABP48145   (96)  FKNTRTNEKVELQELNDRFA (SEQ ID NO: 826)
                VIMENTIN DOG  (96)  FKNTRTNEKVELQELNDRFA (SEQ ID NO: 827)
   VIME RABBIT XP_002717466   (96)  FRNTRTNEKVELQELNDRFA (SEQ ID NO: 533)
                 Consensus    (96)  FKNTRTNEKVELQELNDRFA (SEQ ID NO: 828)

101               122
            VIMENTIN_HUMAN   (101)  TNEKVELQELNDRFANYIDKVR (SEQ ID NO: 9)
                VIME_MOUSE   (101)  TNEKVELQELNDRFANYIDKVR (SEQ ID NO: 829)
                VIME_BOVIN   (101)  TNEKVELQELNDRFANYIDKVR (SEQ ID NO: 830)
                  VIME_PIG   (101)  TNEKVELQELNDRFANYIDKVR (SEQ ID NO: 831)
   VIMENTIN HORSE NP_001230074 (101) TNEKVELQELNDRFASYIDKVR (SEQ ID NO: 832)
 VIMENTIN CHICKEN NP_001041541 (95)  TNEKVELQELNDRFANYIDKVR (SEQ ID NO: 833)
        VIME SHEEP ABP48145  (101)  TNEKVELQELNDRFANYIDKVR (SEQ ID NO: 834)
                VIMENTIN DOG (101)  TNEKVELQELNDRFANYIDKVR (SEQ ID NO: 835)
   VIME RABBIT XP_002717466  (101)  TNEKVELQELNDRFANYIDKVR (SEQ ID NO: 836)
                 Consensus   (101)  TNEKVELQELNDRFANYIDKVR (SEQ ID NO: 837)

116            135
            VIMENTIN_HUMAN   (116)  NYIDKVRFLEQQNKILLAEL (SEQ ID NO: 3)
                VIME_MOUSE   (116)  NYIDKVRFLEQQNKILLAEL (SEQ ID NO: 838)
                VIME_BOVIN   (116)  NYIDKVRFLEQQNKILLAEL (SEQ ID NO: 839)
                  VIME_PIG   (116)  NYIDKVRFLEQQNKILLAEL (SEQ ID NO: 840)
   VIMENTIN HORSE NP_001230074 (116) SYIDKVRFLEQQNKILLAEL (SEQ ID NO: 535)
 VIMENTIN CHICKEN NP_001041541 (110) NYIDKVRFLEQQNKILLAEL (SEQ ID NO: 841)
        VIME SHEEP ABP48145  (116)  NYIDKVRFLEQQNKILLAEL (SEQ ID NO: 842)
                VIMENTIN DOG (116)  NYIDKVRFLEQQNKILLAEL (SEQ ID NO: 843)
   VIME RABBIT XP_002717466  (116)  NYIDKVRFLEQQNKILLAEL (SEQ ID NO: 844)
                 Consensus   (116)  NYIDKVRFLEQQNKILLAEL (SEQ ID NO: 845)
```

Figure 8 contd

```
                                             120           134
              VIMENTIN_HUMAN           (120) KVRFLEQQNKILLAE(SEQ ID NO: 536)
                  VIME_MOUSE           (120) KVRFLEQQNKILLAE(SEQ ID NO: 846)
                  VIME_BOVIN           (120) KVRFLEQQNKILLAE(SEQ ID NO: 847)
                    VIME_PIG           (120) KVRFLEQQNKILLAE(SEQ ID NO: 848)
    VIMENTIN HORSE NP_001230074        (120) KVRFLEQQNKILLAE(SEQ ID NO: 849)
    VIMENTIN CHICKEN NP_001041541      (114) KVRFLEQQNKILLAE(SEQ ID NO: 850)
         VIME SHEEP ABP48145           (120) KVRFLEQQNKILLAE(SEQ ID NO: 851)
                 VIMENTIN DOG          (120) KVRFLEQQNKILLAE(SEQ ID NO: 852)
       VIME RABBIT XP_002717466        (120) KVRFLEQQNKILLAE(SEQ ID NO: 853)
                   Consensus           (120) KVRFLEQQNKILLAE(SEQ ID NO: 854)

215                 235
              VIMENTIN_HUMAN           (215) LARLDLERKVESLQEEIAFLK(SEQ ID NO: 4)
                  VIME_MOUSE           (215) LARLDLERKVESLQEEIAFLK(SEQ ID NO: 855)
                  VIME_BOVIN           (215) LARLDLERKVESLQEEIAFLK(SEQ ID NO: 856)
                    VIME_PIG           (215) LARLDLERKVESLQEEIAFLK(SEQ ID NO: 857)
    VIMENTIN HORSE NP_001230074        (215) LARLDLERKVESLQEEIAFLK(SEQ ID NO: 858)
    VIMENTIN CHICKEN NP_001041541      (209) LAGLDLERPVESLQEEIVFLK(SEQ ID NO: 537)
         VIME SHEEP ABP48145           (215) LARLDLERKVESLQEEIAFLK(SEQ ID NO: 859)
                 VIMENTIN DOG          (215) LARLDLERKVESLQEEIAFLK(SEQ ID NO: 860)
       VIME RABBIT XP_002717466        (215) LARLDLERKVESLQEEIAFLK(SEQ ID NO: 861)
                   Consensus           (215) LARLDLERKVESLQEEIAFLK(SEQ ID NO: 862)

255                   275
              VIMENTIN_HUMAN           (255) QIDVDVSKPDLTAALRDVRQQ(SEQ ID NO: 5)
                  VIME_MOUSE           (255) QIDVDVSKPDLTAALRDVRQQ(SEQ ID NO: 863)
                  VIME_BOVIN           (255) QIDMDVSKPDLTAALRDVRQQ(SEQ ID NO: 864)
                    VIME_PIG           (255) QIDMDVSKPDLTAALRDVRQQ(SEQ ID NO: 865)
    VIMENTIN HORSE NP_001230074        (255) QIDVDVSKPDLTAALRDVRQQ(SEQ ID NO: 866)
    VIMENTIN CHICKEN NP_001041541      (249) QIDMDVSKPDLTAALRDVRQQ(SEQ ID NO: 867)
         VIME SHEEP ABP48145           (255) QIDMDVSQPDLTAALRDVRQQ(SEQ ID NO: 539)
                 VIMENTIN DOG          (255) QIDMDVSKPDLTAALRDVRQQ(SEQ ID NO: 868)
       VIME RABBIT XP_002717466        (255) QIDVDVSKPDLTAALRDVRQQ(SEQ ID NO: 869)
                   Consensus           (255) QIDMDVSKPDLTAALRDVRQQ(SEQ ID NO: 870)

271              288
              VIMENTIN_HUMAN           (271) DVRQQYESVAAKNLQEAE(SEQ ID NO: 11)
                  VIME_MOUSE           (271) DVRQQYESVAAKNLQEAE(SEQ ID NO: 871)
                  VIME_BOVIN           (271) DVRQQYESVAAKNLQEAE(SEQ ID NO: 872)
                    VIME_PIG           (271) DVRQQYESVAAKNLQEAE(SEQ ID NO: 873)
    VIMENTIN HORSE NP_001230074        (271) DVRQQYESVAAKNLQEAE(SEQ ID NO: 874)
    VIMENTIN CHICKEN NP_001041541      (265) DVRQQYESVAAKNLQEAE(SEQ ID NO: 875)
         VIME SHEEP ABP48145           (271) DVRQQYESVAAKNLQEAE(SEQ ID NO: 876)
                 VIMENTIN DOG          (271) DVRQQYESVAAKNLQEAE(SEQ ID NO: 877)
       VIME RABBIT XP_002717466        (271) DVRQQYESVAAKNLQEAE(SEQ ID NO: 878)
                   Consensus           (271) DVRQQYESVAAKNLQEAE(SEQ ID NO: 879)
```

Figure 8 contd

```
                                        286              305
            VIMENTIN_HUMAN  (286) EAEEWYKSKFADLSEAANRN(SEQ ID NO:  12)
                VIME_MOUSE  (286) EAEEWYKSKFADLSEAANRN(SEQ ID NO: 880)
                VIME_BOVIN  (286) EAEEWYKSKFADLSEAANRN(SEQ ID NO: 881)
                  VIME_PIG  (286) EAEEWYKSKFADLSEAANRN(SEQ ID NO: 882)
  VIMENTIN HORSE NP_001230074 (286) EAEEWYKSKFADLSEAANRN(SEQ ID NO: 883)
VIMENTIN CHICKEN NP_001041541 (280) EAEEWYKSKFADLSEAANRN(SEQ ID NO: 884)
       VIME SHEEP ABP48145  (286) EAEEWYKSKFADLSEAANRN(SEQ ID NO: 885)
               VIMENTIN DOG (286) EAEEWYKSKFADLSEAANRN(SEQ ID NO: 886)
    VIME RABBIT XP_002717466 (286) EAEEWYKSKFADLSEAANRN(SEQ ID NO: 887)
                 Consensus  (286) EAEEWYKSKFADLSEAANRN(SEQ ID NO: 888)

286            303
            VIMENTIN_HUMAN  (286) EAEEWYKSKFADLSEAAN(SEQ ID NO:   6)
                VIME_MOUSE  (286) EAEEWYKSKFADLSEAAN(SEQ ID NO: 889)
                VIME_BOVIN  (286) EAEEWYKSKFADLSEAAN(SEQ ID NO: 890)
                  VIME_PIG  (286) EAEEWYKSKFADLSEAAN(SEQ ID NO: 891)
  VIMENTIN HORSE NP_001230074 (286) EAEEWYKSKFADLSEAAN(SEQ ID NO: 892)
VIMENTIN CHICKEN NP_001041541 (280) EAEEWYKSKFADLSEAAN(SEQ ID NO: 893)
       VIME SHEEP ABP48145  (286) EAEEWYKSKFADLSEAAN(SEQ ID NO: 894)
               VIMENTIN DOG (286) EAEEWYKSKFADLSEAAN(SEQ ID NO: 895)
    VIME RABBIT XP_002717466 (286) EAEEWYKSKFADLSEAAN(SEQ ID NO: 896)
                 Consensus  (286) EAEEWYKSKFADLSEAAN(SEQ ID NO: 897)

390             408
            VIMENTIN_HUMAN  (390) KMALDIEIATYRKLLEGEE(SEQ ID NO:  14)
                VIME_MOUSE  (390) KMALDIEIATYRKLLEGEE(SEQ ID NO: 898)
                VIME_BOVIN  (390) KMALDIEIATYRKLLEGEE(SEQ ID NO: 899)
                  VIME_PIG  (390) KMALDIEIATYRKLLEGEE(SEQ ID NO: 900)
  VIMENTIN HORSE NP_001230074 (390) KMALDIEIATYRKLLEGEE(SEQ ID NO: 901)
VIMENTIN CHICKEN NP_001041541 (384) KMALDIEIATYRKLLEGEE(SEQ ID NO: 902)
       VIME SHEEP ABP48145  (390) KMALDIEIATYRKLLEGEE(SEQ ID NO: 903)
               VIMENTIN DOG (390) KMALDIEIATYRKLLEGEE(SEQ ID NO: 904)
    VIME RABBIT XP_002717466 (390) KMALDIEIATYRKLLEGEE(SEQ ID NO: 905)
                 Consensus  (390) KMALDIEIATYRKLLEGEE(SEQ ID NO: 906)
```

Figure 8b.

```
                                         74              93
               ALDOA A HUMAN  (74) IGGVILFHETLYQKADDGRP(SEQ ID NO:  15)
                  ALDOA MOUSE (74) IGGVILFHETLYQKADDGRP(SEQ ID NO: 907)
            ALDOA COW AAI48011 (74) IGGVILFHETLYQKADDGRP(SEQ ID NO: 908)
         ALDOA PIG XP_020943663 (74) IGGVILFHETLYQKADDGRP(SEQ ID NO: 909)
                  ALDOA HORSE (74) IGGVILFHETLYQKADDGRP(SEQ ID NO: 910)
                  ALDOA FELIS (74) IGGVILFHETLYQKTDDGRP(SEQ ID NO: 911)
         ALDOA DOG XP_022275596 (74) IGGVILFHETLYQKTDDGRP(SEQ ID NO: 912)
                 ALDOA RABBIT (74) IGGVILFHETLYQKADDGRP(SEQ ID NO: 913)
                  ALDOA SHEEP (74) IGGVILFHETLYQKADDGRP(SEQ ID NO: 914)
                   Consensus  (74) IGGVILFHETLYQKADDGRP(SEQ ID NO: 915)
```

Figure 8 contd

```
                                    140            157
         ALDOA A HUMAN        (140)  KDGADFAKWRCVLKIGEH (SEQ ID NO: 16)
            ALDOA MOUSE       (140)  KDGADFAKWRCVLKIGEH (SEQ ID NO: 916)
      ALDOA COW AAI48011      (140)  KDGADFAKWRCVLKIGEH (SEQ ID NO: 917)
   ALDOA PIG XP_020943663     (140)  KDGADFAKWRCVLKIGEH (SEQ ID NO: 918)
            ALDOA HORSE       (140)  KDGADFAKWRCVLKIGEH (SEQ ID NO: 919)
            ALDOA FELIS       (140)  KDGADFAKWRCVLKIGEH (SEQ ID NO: 920)
    ALDOA DOG XP_022275596    (140)  KDGADFAKWRCVLKIGEH (SEQ ID NO: 921)
            ALDOA RABBIT      (140)  KDGADFAKWRCVLKIGEH (SEQ ID NO: 922)
            ALDOA SHEEP       (140)  KDGADFAKWRCVLKIGEH (SEQ ID NO: 923)
               Consensus      (140)  KDGADFAKWRCVLKIGEH (SEQ ID NO: 924)

198            216
         ALDOA A HUMAN        (198)  DLKRCQYVTEKVLAAVYKA (SEQ ID NO: 20)
            ALDOA MOUSE       (198)  DLKRCQYVTEKVLAAVYRA (SEQ ID NO: 925)
      ALDOA COW AAI48011      (198)  DLKRCQYVTEKVLAAVYKA (SEQ ID NO: 926)
   ALDOA PIG XP_020943663     (198)  DLKRCQYVTEKVLAAVYKA (SEQ ID NO: 927)
            ALDOA HORSE       (198)  DLKRCQYVTEKVLAAVYKA (SEQ ID NO: 928)
            ALDOA FELIS       (198)  DLKRCQYVTEKVLAAVYKA (SEQ ID NO: 929)
    ALDOA DOG XP_022275596    (198)  DLKRCQYVTEKVLAAVYKA (SEQ ID NO: 930)
            ALDOA RABBIT      (198)  DLKRCQYVTEKVLAAVYKA (SEQ ID NO: 931)
            ALDOA SHEEP       (198)  DLKRCQYVTEKVLAAVYKA (SEQ ID NO: 932)
               Consensus      (198)  DLKRCQYVTEKVLAAVYKA (SEQ ID NO: 933)

208            226
         ALDOA A HUMAN        (208)  KVLAAVYKALSDHHIYLEG (SEQ ID NO: 22)
            ALDOA MOUSE       (208)  KVLAAVYRALSDHHVYLEG (SEQ ID NO: 934)
      ALDOA COW AAI48011      (208)  KVLAAVYKALSDHHIYLEG (SEQ ID NO: 935)
   ALDOA PIG XP_020943663     (208)  KVLAAVYKALSDHHIYLEG (SEQ ID NO: 936)
            ALDOA HORSE       (208)  KVLAAVYKALSDHHIYLEG (SEQ ID NO: 937)
            ALDOA FELIS       (208)  KVLAAVYKALSDHHIYLEG (SEQ ID NO: 938)
    ALDOA DOG XP_022275596    (208)  KVLAAVYKALSDHHIYLEG (SEQ ID NO: 939)
            ALDOA RABBIT      (208)  KVLAAVYKALSDHHIYLEG (SEQ ID NO: 940)
            ALDOA SHEEP       (208)  KVLAAVYKALSDHHIYLEG (SEQ ID NO: 941)
               Consensus      (208)  KVLAAVYKALSDHHIYLEG (SEQ ID NO: 942)

217            235
         ALDOA A HUMAN        (217)  LSDHHIYLEGTLLKPNMVT (SEQ ID NO: 17)
            ALDOA MOUSE       (217)  LSDHHVYLEGTLLKPNMVT (SEQ ID NO: 943)
      ALDOA COW AAI48011      (217)  LSDHHIYLEGTLLKPNMVT (SEQ ID NO: 944)
   ALDOA PIG XP_020943663     (217)  LSDHHIYLEGTLLKPNMVT (SEQ ID NO: 945)
            ALDOA HORSE       (217)  LSDHHIYLEGTLLKPNMVT (SEQ ID NO: 946)
            ALDOA FELIS       (217)  LSDHHIYLEGTLLKPNMVT (SEQ ID NO: 947)
    ALDOA DOG XP_022275596    (217)  LSDHHIYLEGTLLKPNMVT (SEQ ID NO: 948)
            ALDOA RABBIT      (217)  LSDHHIYLEGTLLKPNMVT (SEQ ID NO: 949)
            ALDOA SHEEP       (217)  LSDHHIYLEGTLLKPNMVT (SEQ ID NO: 950)
               Consensus      (217)  LSDHHIYLEGTLLKPNMVT (SEQ ID NO: 951)
```

Figure 8 contd

```
                                  238              256
         ALDOA_A_HUMAN     (238)  HACTQKFSHEEIAMATVTA  (SEQ ID NO: 18)
         ALDOA_MOUSE       (238)  HACTQKFSNEEIAMATVTA  (SEQ ID NO: 518)
     ALDOA_COW_AAI48011    (238)  HACTQKYSHEEIAMATVTA  (SEQ ID NO: 952)
    ALDOA_PIG_XP_020943663 (238)  HACTQKYSHEEIAMATVTA  (SEQ ID NO: 953)
         ALDOA_HORSE       (238)  HACTHKYSHEEIAMATVTA  (SEQ ID NO: 544)
         ALDOA_FELIS       (238)  HACTHKYSHEEIAMATVTA  (SEQ ID NO: 954)
     ALDOA_DOG_XP_022275596(238)  HACTHKYSHEEIAMATVTA  (SEQ ID NO: 955)
         ALDOA_RABBIT      (238)  HACTQKYSHEEIAMATVTA  (SEQ ID NO: 956)
         ALDOA_SHEEP       (238)  HACTQKYSHEEIAMATVTA  (SEQ ID NO: 957)
         Consensus         (238)  HACTQKYSHEEIAMATVTA  (SEQ ID NO: 958)

323              342
         ALDOA_A_HUMAN     (323)  AAQEEYVKRALANSLACQGK  (SEQ ID NO: 21)
         ALDOA_MOUSE       (323)  AAQEEYIKRALANSLACQGK  (SEQ ID NO: 959)
     ALDOA_COW_AAI48011    (323)  AAQEEYVKRALANSLACQGK  (SEQ ID NO: 960)
    ALDOA_PIG_XP_020943663 (323)  AAQEEYVKRALANSLACQGK  (SEQ ID NO: 961)
         ALDOA_HORSE       (323)  AAQEEYVKRALANSLACQGK  (SEQ ID NO: 962)
         ALDOA_FELIS       (323)  AAQEEYVKRALANSLACQGK  (SEQ ID NO: 963)
     ALDOA_DOG_XP_022275596(323)  AAQEEYIKRALANSLACQGK  (SEQ ID NO: 964)
         ALDOA_RABBIT      (323)  AAQEEYVKRALANSLACQGK  (SEQ ID NO: 965)
         ALDOA_SHEEP       (323)  AAQEEYVKRALANSLACQGK  (SEQ ID NO: 966)
         Consensus         (323)  AAQEEYVKRALANSLACQGK  (SEQ ID NO: 967)
```

Figure 8c. Homology of Human Alpha Enolase epitopes with other species

```
                       1              16
    ENOA_HUMAN    (1)  MSILKIHAREIFDSRG (SEQ ID NO: 54)
    ENOA_MOUSE    (1)  MSLRIHAREIFDSRG  (SEQ ID NO: 547)
    ENOA_RAT      (1)  MSILKIHAREIFDSRG (SEQ ID NO: 968)
    ENOA_BOVIN    (1)  MSILKVHAREIFDSRG (SEQ ID NO: 969)
    ENOA_PIG      (1)  MSILKIHAREIFDSRG (SEQ ID NO: 970)
    ENOA_HORSE    (1)  MSILKIHAREIFDSRG (SEQ ID NO: 971)
    ENOA_CHICKEN  (1)  MSILKIHAREIFDSRG (SEQ ID NO: 972)
    ENOA_FELIS    (1)  MSILKVHAREIFDSRG (SEQ ID NO: 973)
    ENOA_CANINE   (1)  MSILKIHAREIFDSRG (SEQ ID NO: 974)
    ENOA_RABBIT   (1)  MSVLKVHAREIFDSRG (SEQ ID NO: 548)
    ENOA_SHEEP    (1)  MSILKVHAREIFDSRG (SEQ ID NO: 975)
    Consensus     (1)  MSILKIHAREIFDSRG (SEQ ID NO: 976)

52             69
    ENOA_HUMAN    (52) NDKTRYMGKGVSKAVEHI (SEQ ID NO: 55)
    ENOA_MOUSE    (52) NDKTRFMGKGVSQAVEHI (SEQ ID NO: 550)
    ENOA_RAT      (52) NDKTRFMGKGVSKAVEHI (SEQ ID NO: 977)
    ENOA_BOVIN    (52) NDKTRYMGKGVSKAVEHI (SEQ ID NO: 978)
    ENOA_PIG      (52) NDKTRYMGKGVSKAVEHI (SEQ ID NO: 979)
    ENOA_HORSE    (52) NDKTRYMGKGVSKAVEHI (SEQ ID NO: 980)
    ENOA_CHICKEN  (52) NDKTRYLGKGVSKAVEHV (SEQ ID NO: 551)
    ENOA_FELIS    (52) NDKTRYMGKGVSKAVEHI (SEQ ID NO: 981)
    ENOA_CANINE   (52) NDKTRYMGKGVSKAVEHI (SEQ ID NO: 982)
    ENOA_RABBIT   (52) NDKTRYMGKGVSKAVEHI (SEQ ID NO: 983)
    ENOA_SHEEP    (52) NDKTRYMGKGVSKAVEHI (SEQ ID NO: 984)
    Consensus     (52) NDKTRYMGKGVSKAVEHI (SEQ ID NO: 985)
```

Figure 8 contd

```
                    100                 121
ENOA_HUMAN   (100)  TENKSKFGANAILGVSLAVCKA (SEQ ID NO: 56)
ENOA_MOUSE   (100)  TENKSKFGANAILGVSLAVCKA (SEQ ID NO: 986)
ENOA_RAT     (100)  TENKSKFGANAILGVSLAVCKA (SEQ ID NO: 987)
ENOA_BOVIN   (100)  TENKSKFGANAILGVSLAVCKA (SEQ ID NO: 988)
ENOA_PIG     (100)  TENKSKFGANAILGVSLAVCKA (SEQ ID NO: 989)
ENOA_HORSE   (100)  TENKSKFGANAILGVSLAVCKA (SEQ ID NO: 990)
ENOA_CHICKEN (100)  TENKSKFGANAILGVSLAVCKA (SEQ ID NO: 991)
ENOA_FELIS   (100)  TENKSKFGANAILGVSLAVCKA (SEQ ID NO: 992)
ENOA_CANINE  (100)  TENKSKFGANAILGVSLAVCKA (SEQ ID NO: 993)
ENOA_RABBIT  (100)  TENKSKFGANAILGVSLAVCKA (SEQ ID NO: 994)
ENOA_SHEEP   (100)  TENKSKFGANAILGVSLAVCKA (SEQ ID NO: 995)
Consensus    (100)  TENKSKFGANAILGVSLAVCKA (SEQ ID NO: 996)

156                 177
ENOA_HUMAN   (156)  GSHAGNKLA-MQEFMILPVGAA (SEQ ID NO: 57)
ENOA_MOUSE   (156)  GSHAGNKLA-MQEFMILPVGAS (SEQ ID NO: 553)
ENOA_RAT     (156)  GSHAGNKLA-MQEFMILPVGAS (SEQ ID NO: 997)
ENOA_BOVIN   (156)  GSHAGNKLA-MQEFMILPVGAE (SEQ ID NO: 998)
ENOA_PIG     (156)  GSHAGNKLA-MQEFMILPVGAE (SEQ ID NO: 554)
ENOA_HORSE   (156)  GSHAGNKLA-MQEFMILPVGAA (SEQ ID NO: 999)
ENOA_CHICKEN (156)  GSHAGNKLA-MQEFMILPVGAD (SEQ ID NO: 555)
ENOA_FELIS   (156)  GSHAGNKLA-MQEFMILPVGAA (SEQ ID NO: 1000)
ENOA_CANINE  (156)  CSHTRNSLRGETKFSIWPSAGG (SEQ ID NO: 556)
ENOA_RABBIT  (156)  GSHAGNKLA-MQEFMILPIGAA (SEQ ID NO: 1001)
ENOA_SHEEP   (156)  GSHAGNKLA-MQEFMILPVGAE (SEQ ID NO: 1002)
Consensus    (156)  GSHAGNKLA MQEFMILPVGAA (SEQ ID NO: 1003)

180                 205
ENOA_HUMAN   (179)  REAMR-IGAEVYHNLKN------VIK (SEQ ID NO: 58)
ENOA_MOUSE   (179)  REAMR-IGAEVYHNLKN------VIK (SEQ ID NO: 1004)
ENOA_RAT     (179)  REAMR-IGAEVYHNLKN------VIK (SEQ ID NO: 1005)
ENOA_BOVIN   (179)  REAMR-IGAEVYHNLKN------VIK (SEQ ID NO: 1006)
ENOA_PIG     (179)  REAMR-IGAEVYHNLKN------VIK (SEQ ID NO: 1007)
ENOA_HORSE   (179)  SEAMR-IGAEVYHNLKN------VIK (SEQ ID NO: 557)
ENOA_CHICKEN (179)  KEAMR-IGAEVYHNLKN------VIK (SEQ ID NO: 558)
ENOA_FELIS   (179)  REAMR-IGAEVYHNLKN------VIK (SEQ ID NO: 1008)
ENOA_CANINE  (180)  QQVLAPMRKEVLDSSKRXLGSEYLVV (SEQ ID NO: 559)
ENOA_RABBIT  (179)  REAMR-IGAEVYHNLKN------VIK (SEQ ID NO: 1009)
ENOA_SHEEP   (179)  REAMR-IGAEVYHNLKN------VIK (SEQ ID NO: 1010)
Consensus    (180)  REAMR IGAEVYHNLKN       VIK (SEQ ID NO: 1011)

196                 220
ENOA_HUMAN   (194)  N------VIKEKYGKDATNVGDEGG (SEQ ID NO: 59)
ENOA_MOUSE   (194)  N------VIKEKYGKDATNVGDEGG (SEQ ID NO: 1012)
ENOA_RAT     (194)  N------VIKEKYGKDATNVGDEGG (SEQ ID NO: 1013)
ENOA_BOVIN   (194)  N------VIKEKYGKDATNVGDEGG (SEQ ID NO: 1014)
ENOA_PIG     (194)  N------VIKEKYGKDATNVGDEGG (SEQ ID NO: 1015)
ENOA_HORSE   (194)  N------VIKEKYGKDATNVGDEGG (SEQ ID NO: 1016)
ENOA_CHICKEN (194)  N------VIKEKYGKDATNVGDEGG (SEQ ID NO: 1017)
ENOA_FELIS   (194)  N------VIKEKYGKDATNVGDEGG (SEQ ID NO: 1018)
ENOA_CANINE  (196)  RXLGSEYLVVILLELPIWQLLKGTF (SEQ ID NO: 560)
ENOA_RABBIT  (194)  N------VIKEKYGKDATNVGDEGG (SEQ ID NO: 1019)
ENOA_SHEEP   (194)  N------VIKEKYGKDATNVGDEGG (SEQ ID NO: 1020)
Consensus    (196)  N       VIKEKYGKDATNVGDEGG (SEQ ID NO: 1021)
```

Figure 8 contd

```
                        258                 277
ENOA_HUMAN     (245)    DVAASEFFRSGKYDLDFKSP    (SEQ ID NO: 60)
ENOA_MOUSE     (245)    DVAASEFYRSGKYDLDFKSP    (SEQ ID NO: 1022)
ENOA_RAT       (245)    DVAASEFYRAGKYDLDFKSP    (SEQ ID NO: 562)
ENOA_BOVIN     (245)    DVAASEFYRSGKYDLDFKSP    (SEQ ID NO: 1023)
ENOA_PIG       (245)    DVAASEFYRSGKYDLDFKSP    (SEQ ID NO: 1024)
ENOA_HORSE     (245)    DVAASEFFRSGKYDLDFKSP    (SEQ ID NO: 1025)
ENOA_CHICKEN   (245)    DVAASEFYRDGKYDLDFKSP    (SEQ ID NO: 563)
ENOA_FELIS     (245)    DVAASEFFRSGKYDLDFKSP    (SEQ ID NO: 1026)
ENOA_CANINE    (258)    DVAASEFFRSGKYDLDFKSP    (SEQ ID NO: 1027)
ENOA_RABBIT    (245)    DVAASEFFRSGKYDLDFKSP    (SEQ ID NO: 1028)
ENOA_SHEEP     (245)    DVAASEFYRSGKYDLDFKSP    (SEQ ID NO: 1029)
Consensus      (258)    DVAASEFYRSGKYDLDFKSP    (SEQ ID NO: 1030)

286               304
ENOA_HUMAN     (273)    PDQLADLYKSFIKDYPVVS     (SEQ ID NO: 61)
ENOA_MOUSE     (273)    PDQLADLYKSFVQNYPVVS     (SEQ ID NO: 564)
ENOA_RAT       (273)    PDQLADLYKSFIKDYPVVS     (SEQ ID NO: 1031)
ENOA_BOVIN     (273)    PDELANLYKSFIRDYPVVS     (SEQ ID NO: 565)
ENOA_PIG       (273)    PDQLADLYKSFIRDYPVVS     (SEQ ID NO: 566)
ENOA_HORSE     (273)    PDELANLYKSFIKDYPVVS     (SEQ ID NO: 567)
ENOA_CHICKEN   (273)    PDQLADLYLGFVKNYPVVS     (SEQ ID NO: 568)
ENOA_FELIS     (273)    PDELANLYKSFIRDYPVVS     (SEQ ID NO: 1032)
ENOA_CANINE    (286)    PDQLADLYKSFIRDYPVVS     (SEQ ID NO: 1033)
ENOA_RABBIT    (273)    PDQLADLYKSFVRDYPVVS     (SEQ ID NO: 569)
ENOA_SHEEP     (273)    PDELADLYKSFIRDYPVVS     (SEQ ID NO: 570)
Consensus      (286)    PDQLADLYKSFIRDYPVVS     (SEQ ID NO: 1034)

314              330
ENOA_HUMAN     (301)    WGAWQKFTASAGIQVVG       (SEQ ID NO: 62)
ENOA_MOUSE     (301)    WGAWQKFTASAGIQVVG       (SEQ ID NO: 1035)
ENOA_RAT       (301)    WDAWQKFTATAGIQVVG       (SEQ ID NO: 571)
ENOA_BOVIN     (301)    WEAWQKFTASAGIQVVG       (SEQ ID NO: 572)
ENOA_PIG       (301)    WEAWQKFTGSAGIQVVG       (SEQ ID NO: 573)
ENOA_HORSE     (301)    WEAWQKFTASAGIQVVG       (SEQ ID NO: 1036)
ENOA_CHICKEN   (301)    WAAWKKFTASVGIQVVG       (SEQ ID NO: 574)
ENOA_FELIS     (301)    WEAWQKFTASAGIQVVG       (SEQ ID NO: 1037)
ENOA_CANINE    (314)    WEAWQKFTASAGIQVVG       (SEQ ID NO: 1039)
ENOA_RABBIT    (301)    WEAWQKFTASAGIQVVG       (SEQ ID NO: 1039)
ENOA_SHEEP     (301)    WEAWQKFTASAGIQVVG       (SEQ ID NO: 1040)
Consensus      (314)    WEAWQKFTASAGIQVVG       (SEQ ID NO: 1041)

346                 365
ENOA_HUMAN     (333)    NEKSCNCLLLKVNQIGSVTE    (SEQ ID NO: 386)
ENOA_MOUSE     (333)    SEKSCNCLLLKVNQIGSVTE    (SEQ ID NO: 575)
ENOA_RAT       (333)    GEKSCNCLLLKVNQIGSVTE    (SEQ ID NO: 576)
ENOA_BOVIN     (333)    SEKSCNCLLLKVNQIGSVTE    (SEQ ID NO: 1042)
ENOA_PIG       (333)    AEKSCNCLLLKVNQIGSVTE    (SEQ ID NO: 577)
ENOA_HORSE     (333)    GEKSCNCLLLKVNQIGSVTE    (SEQ ID NO: 1043)
ENOA_CHICKEN   (333)    EEKSCNCLLLKVNQIGSVTE    (SEQ ID NO: 578)
ENOA_FELIS     (333)    NERSCNCLLLKVNQIGSVTE    (SEQ ID NO: 579)
ENOA_CANINE    (346)    GEKSCNCLLLKVNQIGSVTE    (SEQ ID NO: 1044)
ENOA_RABBIT    (333)    DQKSCNCLLLKVNQIGSVTE    (SEQ ID NO: 580)
ENOA_SHEEP     (333)    SEKSCNCLLLKVNQIGSVTE    (SEQ ID NO: 1045)
Consensus      (346)    EKSCNCLLLKVNQIGSVTE     (SEQ ID NO: 1046)
```

Figure 8 contd

```
                         413                 432
    ENOA_HUMAN   (400)   RSERLAKYNQLLRIEEELGS   (SEQ ID NO: 64)
    ENOA_MOUSE   (400)   RSERLAKYNQILRIEEELGS   (SEQ ID NO: 582)
      ENOA_RAT   (400)   RSERLAKYNQILRIEEELGS   (SEQ ID NO: 1047)
    ENOA_BOVIN   (400)   RSERLAKYNQILRIEEELGS   (SEQ ID NO: 1048)
      ENOA_PIG   (400)   RSERLAKYNQILRIEEELGS   (SEQ ID NO: 1049)
    ENOA_HORSE   (400)   RSERLAKYNQILRIEEELGS   (SEQ ID NO: 1050)
  ENOA_CHICKEN   (400)   RSERLAKYNQLLRIEEELGS   (SEQ ID NO: 1051)
    ENOA_FELIS   (400)   RSERLAKYNQILRIEEELGS   (SEQ ID NO: 1052)
   ENOA_CANINE   (413)   RSERLAKYNQILRIEEELGS   (SEQ ID NO: 1053)
   ENOA_RABBIT   (400)   RSERLAKYNQLLRIEEELGS   (SEQ ID NO: 1054)
    ENOA_SHEEP   (400)   RSERLAKYNQILRIEEELGS   (SEQ ID NO: 1055)
     Consensus   (413)   RSERLAKYNQILRIEEELGS   (SEQ ID NO: 1056)

431             447
    ENOA_HUMAN   (418)   GSKAKFAGRNFRNPLAK   (SEQ ID NO: 65)
    ENOA_MOUSE   (418)   GSKAKFAGRSFRNPLAK   (SEQ ID NO: 583)
      ENOA_RAT   (413)   GSKAKFAGRSFRNPLAK   (SEQ ID NO: 1057)
    ENOA_BOVIN   (418)   GSKAKFAGRSFRNPLAK   (SEQ ID NO: 1058)
      ENOA_PIG   (418)   GSKAKFAGRNFRNPLAK   (SEQ ID NO: 1059)
    ENOA_HORSE   (418)   GSKAKFAGRNFRNPLAK   (SEQ ID NO: 1060)
  ENOA_CHICKEN   (418)   GSKARFAGRNFRNPRIN   (SEQ ID NO: 584)
    ENOA_FELIS   (413)   GSKAKFAGRSFRNPLAK   (SEQ ID NO: 1061)
   ENOA_CANINE   (431)   GSKAKFAGRSFRNPLAK   (SEQ ID NO: 1062)
   ENOA_RABBIT   (418)   GSKAKFAGRNFRNPLAK   (SEQ ID NO: 1063)
    ENOA_SHEEP   (418)   GSKAKFAGRSFRSGRRA   (SEQ ID NO: 585)
     Consensus   (431)   GSKAKFAGRSFRNPLAK   (SEQ ID NO: 1064)
```

Figure 8d. Homology of Human BIP epitopes with other species

```
                               106                 126
    BIP_HUMAN P11021    (104)  NDPSVQQDIKFLPFKVVEKKT   (SEQ ID NO: 38)
    BIP_MOUSE P20029    (105)  NDPSVQQDIKFLPFKVVEKKT   (SEQ ID NO: 1065)
      BIP_RAT P06761    (104)  NDPSVQQDIKFLPFKVVEKKT   (SEQ ID NO: 1066)
   BIP_BOVINE Q0VCX2    (105)  NDPSVQQDIKFLPFKVVEKKT   (SEQ ID NO: 1067)
   BIP_PIG XP_001927830 (104)  NDPSVQQDIKFLPFKVVEKKT   (SEQ ID NO: 1068)
 BIP_HORSE XP_023484632 (104)  NDPSVQQDIKFLPFKVVEKKT   (SEQ ID NO: 1069)
    BIP_CHICKEN Q90593  (102)  NDPSVQQDIKYLPFKVVEKKA   (SEQ ID NO: 586)
   BIP_FELIS XP_006939520 (104) NDPSVQQDIKFLPFKVVEKKT  (SEQ ID NO: 1070)
       BIP_DOG XP_863335 (104) NDPSVQQDIKFLPFKVVEKKT   (SEQ ID NO: 1071)
 BIP_RABBIT XP_017205553 (104) NDPSVQQDIKFLPFKVVEKKT   (SEQ ID NO: 1072)
  BIP_SHEEP XP_004005686 (105) NDPSVQQDIKFLPFKVVEKKT   (SEQ ID NO: 1073)
             Consensus  (106)  NDPSVQQDIKFLPFKVVEKKT   (SEQ ID NO: 1074)
```

Figure 8 contd

```
                                             146           161
        BIP_HUMAN P11021   (144)  EISAMVLTKMKETAEA (SEQ ID NO: 39)
        BIP_MOUSE P20029   (145)  EISAMVLTKMKETAEA (SEQ ID NO: 1075)
          BIP_RAT P06761   (144)  EISAMVLTKMKETAEA (SEQ ID NO: 1076)
       BIP_BOVINE Q0VCX2   (145)  EISAMVLTKMKETAEA (SEQ ID NO: 1077)
    BIP_PIG XP_001927830   (144)  EISAMVLTKMKETAEA (SEQ ID NO: 1078)
  BIP_HORSE XP_023484632   (144)  EISAMVLTKMKETAEA (SEQ ID NO: 1079)
      BIP_CHICKEN Q90593   (142)  EISAMVLTKMKETAEA (SEQ ID NO: 1080)
   BIP_ FELIS XP_006939520 (144)  EISAMVLTKMKETAEA (SEQ ID NO: 1081)
         BIP_DOG XP_863385 (144)  EISAMVLTKMKETAEA (SEQ ID NO: 1082)
  BIP_RABBIT XP_017205553  (144)  EISAMVLTKMKETAEA (SEQ ID NO: 1083)
   BIP_SHEEP XP_004005686  (145)  EISAMVLTKMKETAEA (SEQ ID NO: 1084)
               Consensus   (146)  EISAMVLTKMKETAEA (SEQ ID NO: 1085)

257                 277
        BIP_HUMAN P11021   (255)  GEDFDQRVMEHFIKLYKKKTG (SEQ ID NO: 40)
        BIP_MOUSE P20029   (256)  GEDFDQRVMEHFIKLYKKKTG (SEQ ID NO: 1086)
          BIP_RAT P06761   (255)  GEDFDQRVMEHFIKLYKKKTG (SEQ ID NO: 1087)
       BIP_BOVINE Q0VCX2   (256)  GEDFDQRVMEHFIKLYKKKTG (SEQ ID NO: 1088)
    BIP_PIG XP_001927830   (255)  GEDFDQRVMEHFIKLYKKKTG (SEQ ID NO: 1089)
  BIP_HORSE XP_023484632   (255)  GEDFDQRVMEHFIKLYKKKTG (SEQ ID NO: 1090)
      BIP_CHICKEN Q90593   (253)  GEDFDQRVMEHFIKLYKKKTG (SEQ ID NO: 1091)
   BIP_ FELIS XP_006939520 (255)  GEDFDQRVMEHFIKLYKKKTG (SEQ ID NO: 1092)
         BIP_DOG XP_863385 (255)  GEDFDQRVMEHFIKLYKKKTG (SEQ ID NO: 1093)
  BIP_RABBIT XP_017205553  (255)  GEDFDQRVMEHFIKLYKKKTG (SEQ ID NO: 1094)
   BIP_SHEEP XP_004005686  (256)  GEDFDQRVMEHFIKLYKKKTG (SEQ ID NO: 1095)
               Consensus   (257)  GEDFDQRVMEHFIKLYKKKTG (SEQ ID NO: 1096)

288                   308
        BIP_HUMAN P11021   (286)  QKLRREVEKAKRALSSQHQAR (SEQ ID NO: 41)
        BIP_MOUSE P20029   (287)  QKLRREVEKAKRALSSQHQAR (SEQ ID NO: 1097)
          BIP_RAT P06761   (286)  QKLRREVEKAKRALSSQHQAR (SEQ ID NO: 1098)
       BIP_BOVINE Q0VCX2   (287)  QKLRREVEKAKRALSSQHQAR (SEQ ID NO: 1099)
    BIP_PIG XP_001927830   (286)  QKLRREVEKAKRALSSQHQAR (SEQ ID NO: 1100)
  BIP_HORSE XP_023484632   (286)  QKLRREVEKAKRALSSQHQAR (SEQ ID NO: 1101)
      BIP_CHICKEN Q90593   (284)  QKLRREVEKAKRALSSQHQAR (SEQ ID NO: 1102)
   BIP_ FELIS XP_006939520 (286)  QKLRREVEKAKRALSSQHQAR (SEQ ID NO: 1103)
         BIP_DOG XP_863385 (286)  QKLRREVEKAKRALSSQHQAR (SEQ ID NO: 1104)
  BIP_RABBIT XP_017205553  (286)  QKLRREVEKAKRALSSQHQAR (SEQ ID NO: 1105)
   BIP_SHEEP XP_004005686  (287)  QKLRREVEKAKRALSSQHQAR (SEQ ID NO: 1106)
               Consensus   (288)  QKLRREVEKAKRALSSQHQAR (SEQ ID NO: 1107)

318                  338
        BIP_HUMAN P11021   (316)  EDFSETLTRAKFEELNMDLFR (SEQ ID NO: 42)
        BIP_MOUSE P20029   (317)  EDFSETLTRAKFEELNMDLFR (SEQ ID NO: 1108)
          BIP_RAT P06761   (316)  EDFSETLTRAKFEELNMDLFR (SEQ ID NO: 1109)
       BIP_BOVINE Q0VCX2   (317)  EDFSETLTRAKFEELNMDLFR (SEQ ID NO: 1110)
    BIP_PIG XP_001927830   (316)  EDFSETLTRAKFEELNMDLFR (SEQ ID NO: 1111)
  BIP_HORSE XP_023484632   (316)  EDFSETLTRAKFEELNMDLFR (SEQ ID NO: 1112)
      BIP_CHICKEN Q90593   (314)  EDFSETLTRAKFEELNMDLFR (SEQ ID NO: 1113)
   BIP_ FELIS XP_006939520 (316)  EDFSETLTRAKFEELNMDLFR (SEQ ID NO: 1114)
         BIP_DOG XP_863385 (316)  EDFSETLTRAKFEELNMDLFR (SEQ ID NO: 1115)
  BIP_RABBIT XP_017205553  (316)  EDFSETLTRAKFEELNMDLFR (SEQ ID NO: 1116)
   BIP_SHEEP XP_004005686  (317)  EDFSETLTRAKFEELNMDLFR (SEQ ID NO: 1117)
               Consensus   (318)  EDFSETLTRAKFEELNMDLFR (SEQ ID NO: 1118)
```

Figure 8 contd

```
                                         330            348
        BIP_HUMAN  P11021   (328)  EELNMDLFRSTMKPVQKVL (SEQ ID NO: 43)
        BIP_MOUSE  P20029   (329)  EELNMDLFRSTMKPVQKVL (SEQ ID NO: 1119)
          BIP_RAT  P06761   (328)  EELNMDLFRSTMKPVQKVL (SEQ ID NO: 1120)
       BIP_BOVINE  Q0VCX2   (329)  EELNMDLFRSTMKPVQKVL (SEQ ID NO: 1121)
    BIP_PIG XP_001927830    (328)  EELNMDLFRSTMKPVQKVL (SEQ ID NO: 1122)
  BIP_HORSE XP_023484632    (328)  EELNMDLFRSTMKPVQKVL (SEQ ID NO: 1123)
      BIP_CHICKEN  Q90593   (326)  EELNMDLFRSTMKPVQKVL (SEQ ID NO: 1124)
   BIP_ FELIS XP_006939520  (328)  EELNMDLFRSTMKPVQKVL (SEQ ID NO: 1125)
       BIP_DOG XP_863385    (328)  EELNMDLFRSTMKPVQKVL (SEQ ID NO: 1126)
  BIP_RABBIT XP_017205553   (328)  EELNMDLFRSTMKPVQKVL (SEQ ID NO: 1127)
   BIP_SHEEP XP_004005686   (329)  EELNMDLFRSTMKPVQKVL (SEQ ID NO: 1128)
               Consensus    (330)  EELNMDLFRSTMKPVQKVL (SEQ ID NO: 1129)

369              389
        BIP_HUMAN  P11021   (367)  RIPKIQQLVKEFFNGKEPSRG (SEQ ID NO: 44)
        BIP_MOUSE  P20029   (368)  RIPKIQQLVKEFFNGKEPSRG (SEQ ID NO: 1130)
          BIP_RAT  P06761   (367)  RIPKIQQLVKEFFNGKEPSRG (SEQ ID NO: 1131)
       BIP_BOVINE  Q0VCX2   (368)  RIPKIQQLVKEFFNGKEPSRG (SEQ ID NO: 1132)
    BIP_PIG XP_001927830    (367)  RIPKIQQLVKEFFNGKEPSRG (SEQ ID NO: 1133)
  BIP_HORSE XP_023484632    (367)  RIPKIQQLVKEFFNGKEPSRG (SEQ ID NO: 1134)
      BIP_CHICKEN  Q90593   (365)  RIPKIQQLVKEFFNGKEPSRG (SEQ ID NO: 1135)
   BIP_ FELIS XP_006939520  (367)  RIPKIQQLVKEFFNGKEPSRG (SEQ ID NO: 1136)
       BIP_DOG XP_863385    (367)  RIPKIQQLVKEFFNGKEPSRG (SEQ ID NO: 1137)
  BIP_RABBIT XP_017205553   (367)  RIPKIQQLVKEFFNGKEPSRG (SEQ ID NO: 1138)
   BIP_SHEEP XP_004005686   (368)  RIPKIQQLVKEFFNGKEPSRG (SEQ ID NO: 1139)
               Consensus    (369)  RIPKIQQLVKEFFNGKEPSRG (SEQ ID NO: 1140)

462             482
        BIP_HUMAN  P11021   (460)  TVTIKVYEGERPLTKDNHLLG (SEQ ID NO: 45)
        BIP_MOUSE  P20029   (461)  TVTIKVYEGERPLTKDNHLLG (SEQ ID NO: 1141)
          BIP_RAT  P06761   (460)  TVTIKVYEGERPLTKDNHLLG (SEQ ID NO: 1142)
       BIP_BOVINE  Q0VCX2   (461)  TVTIKVYEGERPLTKDNHLLG (SEQ ID NO: 1143)
    BIP_PIG XP_001927830    (460)  TVTIKVYEGERPLTKDNHLLG (SEQ ID NO: 1144)
  BIP_HORSE XP_023484632    (460)  TVTIKVYEGERPLTKDNHLLG (SEQ ID NO: 1145)
      BIP_CHICKEN  Q90593   (458)  TVTIKVYEGERPLTKDNHLLG (SEQ ID NO: 1146)
   BIP_ FELIS XP_006939520  (460)  TVTIKVYEGERPLTKDNHLLG (SEQ ID NO: 1147)
       BIP_DOG XP_863385    (460)  TVTIKVYEGERPLTKDNHLLG (SEQ ID NO: 1148)
  BIP_RABBIT XP_017205553   (460)  TVTIKVYEGERPLTKDNHLLG (SEQ ID NO: 1149)
   BIP_SHEEP XP_004005686   (461)  TVTIKVYEGERPLTKDNHLLG (SEQ ID NO: 1150)
               Consensus    (462)  TVTIKVYEGERPLTKDNHLLG (SEQ ID NO: 1151)

564           581
        BIP_HUMAN  P11021   (562)  RNELESYAYSLKNQIGDK (SEQ ID NO: 46)
        BIP_MOUSE  P20029   (563)  RNELESYAYSLKNQIGDK (SEQ ID NO: 1152)
          BIP_RAT  P06761   (562)  RNELESYAYSLKNQIGDK (SEQ ID NO: 1153)
       BIP_BOVINE  Q0VCX2   (563)  RNELESYAYSLKNQIGDK (SEQ ID NO: 1154)
    BIP_PIG XP_001927830    (562)  RNELESYAYSLKNQIGDK (SEQ ID NO: 1155)
  BIP_HORSE XP_023484632    (562)  RNELESYAYSLKNQIGDK (SEQ ID NO: 1156)
      BIP_CHICKEN  Q90593   (560)  RNELESYAYSLKNQIGDK (SEQ ID NO: 1157)
   BIP_ FELIS XP_006939520  (562)  RNELESYAYSLKNQIGDK (SEQ ID NO: 1158)
       BIP_DOG XP_863385    (562)  RNELESYAYSLKNQIGDK (SEQ ID NO: 1159)
  BIP_RABBIT XP_017205553   (562)  RNELESYAYSLKNQIGDK (SEQ ID NO: 1160)
   BIP_SHEEP XP_004005686   (563)  RNELESYAYSLKNQIGDK (SEQ ID NO: 1161)
               Consensus    (564)  RNELESYAYSLKNQIGDK (SEQ ID NO: 1162)
```

Figure 8 contd

```
                                        622                 641
         BIP_HUMAN P11021    (620)  KKELEEIVQPIISKLYGSAG  (SEQ ID NO: 47)
         BIP_MOUSE P20029    (621)  KKELEEIVQPIISKLYGSGG  (SEQ ID NO: 587)
           BIP_RAT P06761    (620)  KKELEEIVQPIISKLYGSGG  (SEQ ID NO: 1163)
        BIP_BOVINE Q0VCX2    (621)  KKELEEIVQPIISKLYGSAG  (SEQ ID NO: 1164)
     BIP_PIG XP_001927830    (620)  KKELEEIVQPIISKLYGSAG  (SEQ ID NO: 1165)
   BIP_HORSE XP_023484632    (620)  KKELEEIVQPIISKLYGSAG  (SEQ ID NO: 1166)
       BIP_CHICKEN Q90593    (618)  KKELEEVVQPIVSKLYGSAG  (SEQ ID NO: 588)
    BIP_FELIS XP_006939520   (620)  KKELEEIVQPIISKLYGSAG  (SEQ ID NO: 1167)
        BIP_DOG XP_863385    (620)  KKELEEIVQPIISKLYGSAG  (SEQ ID NO: 1168)
   BIP_RABBIT XP_017205553   (620)  KKELEEIVQPIISKLYGSAG  (SEQ ID NO: 1169)
    BIP_SHEEP XP_004005686   (621)  KKELEEIVQPIISKLYGSAG  (SEQ ID NO: 1170)
                Consensus    (622)  KKELEEIVQPIISKLYGSAG  (SEQ ID NO: 1171)
```

Figure 8e. Homology of Human β Catenin epitopes with other species

```
                                        127                 144
          CTNB1_HUMAN P35222   (127)  EPSQMLKHAVVNLINYQD  (SEQ ID NO: 66)
          CTNB1_MOUSE Q02248   (127)  EPSQMLKHAVVNLINYQD  (SEQ ID NO: 1172)
            CTNB1_RAT Q9WU82   (127)  EPSQMLKHAVVNLINYQD  (SEQ ID NO: 1173)
         CTNB1_BOVINE Q0VCX4  (127)  EPSQMLKHAVVNLINYQD  (SEQ ID NO: 1174)
          CTNB1_PIG NP_999532 (127)  EPSQMLKHAVVNLINYQD  (SEQ ID NO: 1175)
      CTNB1_HORSE NP_001116234 (127) EPSQMLKHAVVNLINYQD  (SEQ ID NO: 1176)
      CTNB1_CHICKEN NP_990412 (127)  EPSQMLKHAVVNLINYQD  (SEQ ID NO: 1177)
      CTNB1_FELIS XP_003992261 (127) EPSQMLKHAVVNLINYQD  (SEQ ID NO: 1178)
            CTNB1_DOG B6V8E6   (127)  EPSQMLKHAVVNLINYQD  (SEQ ID NO: 1179)
     CTNB1_RABBIT XP_002713121 (127) EPSQMLKHAVVNLINYQD  (SEQ ID NO: 1180)
         CTNB1_SHEEP AFX73758  (127)  EPSQMLKHAVVNLINYQD  (SEQ ID NO: 1181)
                  Consensus    (127)  EPSQMLKHAVVNLINYQD  (SEQ ID NO: 1182)

258                 275
          CTNB1_HUMAN P35222   (258)  TLHNLLLHQEGAKMAVRL  (SEQ ID NO: 69)
          CTNB1_MOUSE Q02248   (258)  TLHNLLLHQEGAKMAVRL  (SEQ ID NO: 1183)
            CTNB1_RAT Q9WU82   (258)  TLHNLLLHQEGAKMAVRL  (SEQ ID NO: 1184)
         CTNB1_BOVINE Q0VCX4  (258)  TLHNLLLHQEGAKMAVRL  (SEQ ID NO: 1185)
          CTNB1_PIG NP_999532 (258)  TLHNLLLHQEGAKMAVRL  (SEQ ID NO: 1186)
      CTNB1_HORSE NP_001116234 (258) TLHNLLLHQEGAKMAVRL  (SEQ ID NO: 1187)
      CTNB1_CHICKEN NP_990412 (258)  TLHNLLLHQEGAKMAVRL  (SEQ ID NO: 1188)
      CTNB1_FELIS XP_003992261 (258) TLHNLLLHQEGAKMAVRL  (SEQ ID NO: 1189)
            CTNB1_DOG B6V8E6   (258)  TLHNLLLHQEGAKMAVRL  (SEQ ID NO: 1190)
     CTNB1_RABBIT XP_002713121 (258) TLHNLLLHQEGAKMAVRL  (SEQ ID NO: 1191)
         CTNB1_SHEEP AFX73758  (258)  TLHNLLLHQEGAKMAVRL  (SEQ ID NO: 1192)
                  Consensus    (258)  TLHNLLLHQEGAKMAVRL  (SEQ ID NO: 1193)
```

Figure 8 contd

```
                                           269                  288
         CTNB1_HUMAN P35222      (269) AKMAVRLAGGLQKMVALLNK (SEQ ID NO: 69)
         CTNB1_MOUSE Q02248      (269) AKMAVRLAGGLQKMVALLNK (SEQ ID NO: 1194)
           CTNB1_RAT Q9WU82      (269) AKMAVRLAGGLQKMVALLNK (SEQ ID NO: 1195)
        CTNB1_BOVINE Q0VCX4      (269) AKMAVRLAGGLQKMVALLNK (SEQ ID NO: 1196)
        CTNB1_PIG NP_999532      (269) AKMAVRLAGGLQKMVALLNK (SEQ ID NO: 1197)
    CTNB1_HORSE NP_001116234     (269) AKMAVRLAGGLQKMVALLNK (SEQ ID NO: 1198)
    CTNB1_CHICKEN NP_990412      (269) AKMAVRLAGGLQKMVALLNK (SEQ ID NO: 1199)
    CTNB1_FELIS XP_003992261     (269) AKMAVRLAGGLQKMVALLNK (SEQ ID NO: 1200)
            CTNB1_DOG B6V8E6     (269) AKMAVRLAGGLQKMVALLNK (SEQ ID NO: 1201)
    CTNB1_RABBIT XP_002713121    (269) AKMAVRLAGGLQKMVALLNK (SEQ ID NO: 1202)
      CTNB1_SHEEP AFX73758       (269) AKMAVRLAGGLQKMVALLNK (SEQ ID NO: 1203)
                   Consensus     (269) AKMAVRLAGGLQKMVALLNK (SEQ ID NO: 1204)

288                  307
         CTNB1_HUMAN P35222      (288) KTNVKFLAITTDCLQILAYG (SEQ ID NO: 70)
         CTNB1_MOUSE Q02248      (288) KTNVKFLAITTDCLQILAYG (SEQ ID NO: 1205)
           CTNB1_RAT Q9WU82      (288) KTNVKFLAITTDCLQILAYG (SEQ ID NO: 1206)
        CTNB1_BOVINE Q0VCX4      (288) KTNVKFLAITTDCLQILAYG (SEQ ID NO: 1207)
        CTNB1_PIG NP_999532      (288) KTNVKFLAITTDCLQILAYG (SEQ ID NO: 1208)
    CTNB1_HORSE NP_001116234     (288) KTNVKFLAITTDCLQILAYG (SEQ ID NO: 1209)
    CTNB1_CHICKEN NP_990412      (288) KTNVKFLAITTDCLQILAYG (SEQ ID NO: 1210)
    CTNB1_FELIS XP_003992261     (288) KTNVKFLAITTDCLQILAYG (SEQ ID NO: 1211)
            CTNB1_DOG B6V8E6     (288) KTNVKFLAITTDCLQILAYG (SEQ ID NO: 1212)
    CTNB1_RABBIT XP_002713121    (288) KTNVKFLAITTDCLQILAYG (SEQ ID NO: 1213)
      CTNB1_SHEEP AFX73758       (288) KTNVKFLAITTDCLQILAYG (SEQ ID NO: 1214)
                   Consensus     (288) KTNVKFLAITTDCLQILAYG (SEQ ID NO: 1215)

332                349
         CTNB1_HUMAN P35222      (332) TYEKLLWTTSRVLKVLSV (SEQ ID NO: 71)
         CTNB1_MOUSE Q02248      (332) TYEKLLWTTSRVLKVLSV (SEQ ID NO: 1216)
           CTNB1_RAT Q9WU82      (332) TYEKLLWTTSRVLKVLSV (SEQ ID NO: 1217)
        CTNB1_BOVINE Q0VCX4      (332) TYEKLLWTTSRVLKVLSV (SEQ ID NO: 1218)
        CTNB1_PIG NP_999532      (332) TYEKLLWTTSRVLKVLSV (SEQ ID NO: 1219)
    CTNB1_HORSE NP_001116234     (332) TYEKLLWTTSRVLKVLSV (SEQ ID NO: 1220)
    CTNB1_CHICKEN NP_990412      (332) TYEKLLWTTSRVLKVLSV (SEQ ID NO: 1221)
    CTNB1_FELIS XP_003992261     (332) TYEKLLWTTSRVLKVLSV (SEQ ID NO: 1222)
            CTNB1_DOG B6V8E6     (332) TYEKLLWTTSRVLKVLSV (SEQ ID NO: 1223)
    CTNB1_RABBIT XP_002713121    (332) TYEKLLWTTSRVLKVLSV (SEQ ID NO: 1224)
      CTNB1_SHEEP AFX73758       (332) TYEKLLWTTSRVLKVLSV (SEQ ID NO: 1225)
                   Consensus     (332) TYEKLLWTTSRVLKVLSV (SEQ ID NO: 1226)

334                  354
         CTNB1_HUMAN P35222      (334) EKLLWTTSRVLKVLSVCSSNK (SEQ ID NO: 67)
         CTNB1_MOUSE Q02248      (334) EKLLWTTSRVLKVLSVCSSNK (SEQ ID NO: 1227)
           CTNB1_RAT Q9WU82      (334) EKLLWTTSRVLKVLSVCSSNK (SEQ ID NO: 1228)
        CTNB1_BOVINE Q0VCX4      (334) EKLLWTTSRVLKVLSVCSSNK (SEQ ID NO: 1229)
        CTNB1_PIG NP_999532      (334) EKLLWTTSRVLKVLSVCSSNK (SEQ ID NO: 1230)
    CTNB1_HORSE NP_001116234     (334) EKLLWTTSRVLKVLSVCSSNK (SEQ ID NO: 1231)
    CTNB1_CHICKEN NP_990412      (334) EKLLWTTSRVLKVLSVCSSNK (SEQ ID NO: 1232)
    CTNB1_FELIS XP_003992261     (334) EKLLWTTSRVLKVLSVCSSNK (SEQ ID NO: 1233)
            CTNB1_DOG B6V8E6     (334) EKLLWTTSRVLKVLSVCSSNK (SEQ ID NO: 1234)
    CTNB1_RABBIT XP_002713121    (334) EKLLWTTSRVLKVLSVCSSNK (SEQ ID NO: 1235)
      CTNB1_SHEEP AFX73758       (334) EKLLWTTSRVLKVLSVCSSNK (SEQ ID NO: 1236)
                   Consensus     (334) EKLLWTTSRVLKVLSVCSSNK (SEQ ID NO: 1237)
```

Figure 8 contd

```
                                    340             358
       CTNB1_HUMAN P35222     (340) TSRVLKVLSVCSSNKPAIV (SEQ ID NO: 72)
       CTNB1_MOUSE Q02248     (340) TSRVLKVLSVCSSNKPAIV (SEQ ID NO: 1238)
         CTNB1_RAT Q9WU82     (340) TSRVLKVLSVCSSNKPAIV (SEQ ID NO: 1239)
      CTNB1_BOVINE Q0VCX4     (340) TSRVLKVLSVCSSNKPAIV (SEQ ID NO: 1240)
         CTNB1_PIG NP_999532  (340) TSRVLKVLSVCSSNKPAIV (SEQ ID NO: 1241)
    CTNB1_HORSE NP_001116234  (340) TSRVLKVLSVCSSNKPAIV (SEQ ID NO: 1242)
    CTNB1_CHICKEN NP_990412   (340) TSRVLKVLSVCSSNKPAIV (SEQ ID NO: 1243)
    CTNB1_FELIS XP_003992261  (340) TSRVLKVLSVCSSNKPAIV (SEQ ID NO: 1244)
         CTNB1_DOG B6V8E6     (340) TSRVLKVLSVCSSNKPAIV (SEQ ID NO: 1245)
    CTNB1_RABBIT XP_002713121 (340) TSRVLKVLSVCSSNKPAIV (SEQ ID NO: 1246)
       CTNB1_SHEEP AFX73758   (340) TSRVLKVLSVCSSNKPAIV (SEQ ID NO: 1247)
                    Consensus (340) TSRVLKVLSVCSSNKPAIV (SEQ ID NO: 1248)

489             506
       CTNB1_HUMAN P35222     (489) YGLPVVVKLLHPPSHWPL (SEQ ID NO: 73)
       CTNB1_MOUSE Q02248     (489) YGLPVVVKLLHPPSHWPL (SEQ ID NO: 1249)
         CTNB1_RAT Q9WU82     (489) YGLPVVVKLLHPPSHWPL (SEQ ID NO: 1250)
      CTNB1_BOVINE Q0VCX4     (489) YGLPVVVKLLHPPSHWPL (SEQ ID NO: 1251)
         CTNB1_PIG NP_999532  (489) YGLPVVVKLLHPPSHWPL (SEQ ID NO: 1252)
    CTNB1_HORSE NP_001116234  (489) YGLPVVVKLLHPPSHWPL (SEQ ID NO: 1253)
    CTNB1_CHICKEN NP_990412   (489) YGLPVVVKLLHPPSHWPL (SEQ ID NO: 1254)
    CTNB1_FELIS XP_003992261  (489) YGLPVVVKLLHPPSHWPL (SEQ ID NO: 1255)
         CTNB1_DOG B6V8E6     (489) YGLPVVVKLLHPPSHWPL (SEQ ID NO: 1256)
    CTNB1_RABBIT XP_002713121 (489) YGLPVVVKLLHPPSHWPL (SEQ ID NO: 1257)
       CTNB1_SHEEP AFX73758   (489) YGLPVVVKLLHPPSHWPL (SEQ ID NO: 1258)
                    Consensus (489) YGLPVVVKLLHPPSHWPL (SEQ ID NO: 1259)

503              522
       CTNB1_HUMAN P35222     (503) HWPLIKATVGLIRNLALCPA (SEQ ID NO: 74)
       CTNB1_MOUSE Q02248     (503) HWPLIKATVGLIRNLALCPA (SEQ ID NO: 1260)
         CTNB1_RAT Q9WU82     (503) HWPLIKATVGLIRNLALCPA (SEQ ID NO: 1261)
      CTNB1_BOVINE Q0VCX4     (503) HWPLIKATVGLIRNLALCPA (SEQ ID NO: 1262)
         CTNB1_PIG NP_999532  (503) HWPLIKATVGLIRNLALCPA (SEQ ID NO: 1263)
    CTNB1_HORSE NP_001116234  (503) HWPLIKATVGLIRNLALCPA (SEQ ID NO: 1264)
    CTNB1_CHICKEN NP_990412   (503) HWPLIKATVGLIRNLALCPA (SEQ ID NO: 1265)
    CTNB1_FELIS XP_003992261  (503) HWPLIKATVGLIRNLALCPA (SEQ ID NO: 1266)
         CTNB1_DOG B6V8E6     (503) HWPLIKATVGLIRNLALCPA (SEQ ID NO: 1267)
    CTNB1_RABBIT XP_002713121 (503) HWPLIKATVGLIRNLALCPA (SEQ ID NO: 1268)
       CTNB1_SHEEP AFX73758   (503) HWPLIKATVGLIRNLALCPA (SEQ ID NO: 1269)
                    Consensus (503) HWPLIKATVGLIRNLALCPA (SEQ ID NO: 1270)

607             625
       CTNB1_HUMAN P35222     (607) IENIQRVAAGVLCELAQDK (SEQ ID NO: 75)
       CTNB1_MOUSE Q02248     (607) IENIQRVAAGVLCELAQDK (SEQ ID NO: 1271)
         CTNB1_RAT Q9WU82     (607) IENIQRVAAGVLCELAQDK (SEQ ID NO: 1272)
      CTNB1_BOVINE Q0VCX4     (607) IENIQRVAAGVLCELAQDK (SEQ ID NO: 1273)
         CTNB1_PIG NP_999532  (607) IENIQRVAAGVLCELAQDK (SEQ ID NO: 1274)
    CTNB1_HORSE NP_001116234  (607) IENIQRVAAGVLCELAQDK (SEQ ID NO: 1275)
    CTNB1_CHICKEN NP_990412   (607) IENIQRVAAGVLCELAQDK (SEQ ID NO: 1276)
    CTNB1_FELIS XP_003992261  (607) IENIQRVAAGVLCELAQDK (SEQ ID NO: 1277)
         CTNB1_DOG B6V8E6     (607) IENIQRVAAGVLCELAQDK (SEQ ID NO: 1278)
    CTNB1_RABBIT XP_002713121 (607) IENIQRVAAGVLCELAQDK (SEQ ID NO: 1279)
       CTNB1_SHEEP AFX73758   (607) IENIQRVAAGVLCELAQDK (SEQ ID NO: 1280)
                    Consensus (607) IENIQRVAAGVLCELAQDK (SEQ ID NO: 1281)
```

Figure 8 contd

```
                                   650              667
         CTNB1_HUMAN P35222   (650) GVATYAAAVLFRMSEDKP (SEQ ID NO: 76)
         CTNB1_MOUSE Q02248   (650) GVATYAAAVLFRMSEDKP (SEQ ID NO: 1282)
           CTNB1_RAT Q9WU82   (650) GVATYAAAVLFRMSEDKP (SEQ ID NO: 1283)
        CTNB1_BOVINE Q0VCX4   (650) GVATYAAAVLFRMSEDKP (SEQ ID NO: 1284)
        CTNB1_PIG NP_999532   (650) GVATYAAAVLFRMSEDKP (SEQ ID NO: 1285)
    CTNB1_HORSE NP_001116234  (650) GVATYAAAVLFRMSEDKP (SEQ ID NO: 1286)
    CTNB1_CHICKEN NP_990412   (650) GVATYAAAVLFRMSEDKP (SEQ ID NO: 1287)
    CTNB1_FELIS XP_003992261  (650) GVATYAAAVLFRMSEDKP (SEQ ID NO: 1288)
           CTNB1_DOG B6V8E6   (650) GVATYAAAVLFRMSEDKP (SEQ ID NO: 1289)
    CTNB1_RABBIT XP_002713121 (650) GVATYAAAVLFRMSEDKP (SEQ ID NO: 1290)
       CTNB1_SHEEP AFX73758   (650) GVATYAAAVLFRMSEVKP (SEQ ID NO: 1291)
                   Consensus  (650) GVATYAAAVLFRMSEDKP (SEQ ID NO: 1292)
```

Figure 8f. Homology of Human Cytokeratin 8 epitopes with other species

```
                                   102              121
           K2C8_HUMAN P05787   (93)  EQIKTLNNKFASFIDKVRFL (SEQ ID NO: 589)
           K2C8_MOUSE P11679   (99)  EQIKSLNNKFASFIDKVRFL (SEQ ID NO: 1293)
             K2C8_RAT Q10758   (93)  EQIKTLNNKFASFIDKVRFL (SEQ ID NO: 1294)
          K2C8_BOVINE P05786   (100) EQIKTLNNKFASFIDKVRHL (SEQ ID NO: 590)
        K2C8_PIG NP_001153087  (101) EQIKTLNNKFASFIDKVRHL (SEQ ID NO: 1295)
        K2C8_HORSE XP_023499379 (99) EQIKTLNNKFASFIDKVRHL (SEQ ID NO: 1296)
      K2C8_CHICKEN XP_015128103 (95) EQIKTLNNRFASFIDKVRFL (SEQ ID NO: 591)
        K2C8_FELIS XP_003988794 (99) EQIKTLNNRFASFIDKVRHL (SEQ ID NO: 592)
        K2C8_DOG NP_001332968  (101) EQIKSLNNKFASFIDKVRHL (SEQ ID NO: 593)
      K2C8_RABBIT XP_008254718  (96) EQIKSLNNKFASFIDKVRFL (SEQ ID NO: 1297)
       K2C8_SHEEP XP_012004593 (100) EQIKTLNNKFASFIDKVRHL (SEQ ID NO: 1298)
                    Consensus  (102) EQIKTLNNKFASFIDKVRHL (SEQ ID NO: 1299)

110              129
           K2C8_HUMAN P05787   (101) KFASFIDKVRFLEQQNKMLE (SEQ ID NO: 25)
           K2C8_MOUSE P11679   (107) KFASFIDKVRFLEQQNKMLE (SEQ ID NO: 1300)
             K2C8_RAT Q10758   (101) KFASFIDKVRFLEQQNKMLE (SEQ ID NO: 1301)
          K2C8_BOVINE P05786   (108) KFASFIDKVRHLEQQNKVLE (SEQ ID NO: 594)
        K2C8_PIG NP_001153087  (109) KFASFIDKVRHLEQQNKVLE (SEQ ID NO: 1302)
        K2C8_HORSE XP_023499379 (107) KFASFIDKVRHLEQQNKILE (SEQ ID NO: 595)
      K2C8_CHICKEN XP_015128103 (103) RFASFIDKVRFLEQQNKMLE (SEQ ID NO: 596)
        K2C8_FELIS XP_003988794 (107) RFASFIDKVRHLEQQNKILE (SEQ ID NO: 597)
        K2C8_DOG NP_001332968  (109) KFASFIDKVRHLEQQNKILE (SEQ ID NO: 1303)
      K2C8_RABBIT XP_008254718 (104) KFASFIDKVRFLEQQNKMLE (SEQ ID NO: 1304)
       K2C8_SHEEP XP_012004593 (108) KFASFIDKVRHLEQQNKVLE (SEQ ID NO: 1305)
                    Consensus  (110) KFASFIDKVRHLEQQNKMLE (SEQ ID NO: 598)
```

Figure 8 contd

```
                                              121            140
      K2C8_HUMAN P05787    (112) LEQQNKMLETKWSLLQQQKT    (SEQ ID NO: 26)
      K2C8_MOUSE P11679    (118) LEQQNKMLETKWSLLQQQKT    (SEQ ID NO: 1306)
        K2C8_RAT Q10758    (112) LEQQNKMLETKWSLLQQQKT    (SEQ ID NO: 1307)
     K2C8_BOVINE P05786    (119) LEQQNKVLETKWNLLQQQKT    (SEQ ID NO: 599)
     K2C8_PIG NP_001153087 (120) LEQQNKVLETKWNLLQQQKT    (SEQ ID NO: 1308)
    K2C8_HORSE XP_023499379(118) LEQQNKILETKWSFLQQQKT    (SEQ ID NO: 600)
  K2C8_CHICKEN XP_015128103(114) LEQQNKMLETKWSLLQSQQP    (SEQ ID NO: 601)
    K2C8_FELIS XP_003988794(118) LEQQNKILETKWNLLQQQKT    (SEQ ID NO: 602)
     K2C8_DOG NP_001332968 (120) LEQQNKILETKWNLLQQQKT    (SEQ ID NO: 603)
   K2C8_RABBIT XP_008254718(115) LEQQNKMLETKWSLLQQQKT    (SEQ ID NO: 1309)
    K2C8_SHEEP XP_012004593(119) LEQQNKVLETKWNLLQQQKT    (SEQ ID NO: 1310)
              Consensus    (121) LEQQNKMLETKWSLLQQQKT    (SEQ ID NO: 1311)

129            149
      K2C8_HUMAN P05787    (120) ETKWSLLQQQKTARSNMDNMF   (SEQ ID NO: 31)
      K2C8_MOUSE P11679    (126) ETKWSLLQQQKTSRSNMDNMF   (SEQ ID NO: 604)
        K2C8_RAT Q10758    (120) ETKWSLLQQQKTSRSNMDNMF   (SEQ ID NO: 1312)
     K2C8_BOVINE P05786    (127) ETKWNLLQQQKTARSNIDNMF   (SEQ ID NO: 605)
     K2C8_PIG NP_001153087 (128) ETKWNLLQQQKTARSNIDNMF   (SEQ ID NO: 1313)
    K2C8_HORSE XP_023499379(126) ETKWSFLQQQKTARSNMDNMF   (SEQ ID NO: 606)
  K2C8_CHICKEN XP_015128103(122) ETKWSLLQSQQPQRSDLRGLF   (SEQ ID NO: 607)
    K2C8_FELIS XP_003988794(126) ETKWNLLQQQKTARSNMDNMF   (SEQ ID NO: 608)
     K2C8_DOG NP_001332968 (128) ETKWSLLQQQKTSRSNIDNMF   (SEQ ID NO: 609)
   K2C8_RABBIT XP_008254718(123) ETKWSLLQQQKTARSNMDNMF   (SEQ ID NO: 1314)
    K2C8_SHEEP XP_012004593(127) ETKWNLLQQQKTARSNIDNMF   (SEQ ID NO: 1315)
              Consensus    (129) ETKWSLLQQQKTARSNMDNMF   (SEQ ID NO: 1316)

191            211
      K2C8_HUMAN P05787    (182) EINKRTEMENEFVLIKKDVDE   (SEQ ID NO: 28)
      K2C8_MOUSE P11679    (188) EINKRTEMENEFVLIKKDVDE   (SEQ ID NO: 1317)
        K2C8_RAT Q10758    (182) EINKRTEMENEFVLIKKDVDE   (SEQ ID NO: 1318)
     K2C8_BOVINE P05786    (189) EIQKRTDMENEFVIIKKDVDE   (SEQ ID NO: 610)
     K2C8_PIG NP_001153087 (190) EIQKRTDMENEFVIIKKDVDE   (SEQ ID NO: 1319)
    K2C8_HORSE XP_023499379(188) EINKRTEKENEFVLIKKDVDE   (SEQ ID NO: 611)
  K2C8_CHICKEN XP_015128103(184) EINHRTEKENEFVLLKKDVDE   (SEQ ID NO: 612)
    K2C8_FELIS XP_003988794(188) EIKERADMENEFVLIKKDVDE   (SEQ ID NO: 613)
     K2C8_DOG NP_001332968 (190) EIKLRGDMENEFVLIKKDVDE   (SEQ ID NO: 614)
   K2C8_RABBIT XP_008254718(185) EINKRTEMENEFVLIKKDVDE   (SEQ ID NO: 1320)
    K2C8_SHEEP XP_012004593(189) EIQKRTDMENEFVIIKKDVDE   (SEQ ID NO: 1321)
              Consensus    (191) EINKRTEMENEFVLIKKDVDE   (SEQ ID NO: 1322)

199            217
      K2C8_HUMAN P05787    (190) ENEFVLIKKDVDEAYMNKV     (SEQ ID NO: 33)
      K2C8_MOUSE P11679    (196) ENEFVLIKKDVDEAYMNKV     (SEQ ID NO: 1323)
        K2C8_RAT Q10758    (190) ENEFVLIKKDVDEAYMNKV     (SEQ ID NO: 1324)
     K2C8_BOVINE P05786    (197) ENEFVIIKKDVDEAYMNKV     (SEQ ID NO: 1325)
     K2C8_PIG NP_001153087 (198) ENEFVIIKKDVDEAYMNKV     (SEQ ID NO: 1326)
    K2C8_HORSE XP_023499379(196) ENEFVLIKKDVDEAYMNKV     (SEQ ID NO: 1327)
  K2C8_CHICKEN XP_015128103(192) ENEFVLLKKDVDEAYMSKV     (SEQ ID NO: 616)
    K2C8_FELIS XP_003988794(196) ENEFVLIKKDVDEAYMNKV     (SEQ ID NO: 1328)
     K2C8_DOG NP_001332968 (198) ENEFVLIKKDVDEAYMNKI     (SEQ ID NO: 617)
   K2C8_RABBIT XP_008254718(193) ENEFVLIKKDVDEAYMNKV     (SEQ ID NO: 1329)
    K2C8_SHEEP XP_012004593(197) ENEFVIIKKDVDEAYMNKV     (SEQ ID NO: 615)
              Consensus    (199) ENEFVLIKKDVDEAYMNKV     (SEQ ID NO: 1330)
```

Figure 8 contd

```
                                        303             319
       K2C8_HUMAN P05787   (294)  GKHGDDLRRTKTEISEM  (SEQ ID NO: 34)
       K2C8_MOUSE P11679   (300)  GKHGDDLRRTKTEISEM  (SEQ ID NO: 1331)
         K2C8_RAT Q10758   (294)  GKHGDDLRRSKTEISEM  (SEQ ID NO: 618)
      K2C8_BOVINE P05786   (301)  GKHGDDLRRTKTEISEM  (SEQ ID NO: 1332)
      K2C8_PIG NP_001153087 (302) GKHGDDLRRTKTEISEM  (SEQ ID NO: 1333)
     K2C8_HORSE XP_023499379 (300) GKHGDDLRRTKTEISET (SEQ ID NO: 619)
   K2C8_CHICKEN XP_015128103 (296) GKHGDDLRTTRSEISEL (SEQ ID NO: 620)
     K2C8_FELIS XP_003988794 (300) GKHGDDLRRTKTEISEM (SEQ ID NO: 1334)
       K2C8_DOG NP_001332968 (302) GKHGDDLRRTKTEISEM (SEQ ID NO: 1335)
    K2C8_RABBIT XP_008254718 (297) GKHGDDLRRTKTEISEM (SEQ ID NO: 1336)
     K2C8_SHEEP XP_012004593 (301) GKHGDDLRRTKTEISEM (SEQ ID NO: 1337)
              Consensus     (303) GKHGDDLRRTKTEISEM  (SEQ ID NO: 1338)

329             347
       K2C8_HUMAN P05787   (320)  EIEGLKGQRASLEAAIADA (SEQ ID NO: 36)
       K2C8_MOUSE P11679   (326)  EIEALKGQRASLEAAIADA (SEQ ID NO: 621)
         K2C8_RAT Q10758   (320)  EIDALKGQRATLEAAIADA (SEQ ID NO: 622)
      K2C8_BOVINE P05786   (327)  EIEGLKGQRASLEAAIADA (SEQ ID NO: 1339)
      K2C8_PIG NP_001153087 (328) EIEGLKGQRASLEAAIADA (SEQ ID NO: 1340)
     K2C8_HORSE XP_023499379 (326) EIDGLKGQNAALEAAIADA (SEQ ID NO: 623)
   K2C8_CHICKEN XP_015128103 (322) EIEVLKNQRATLETAIAEA (SEQ ID NO: 624)
     K2C8_FELIS XP_003988794 (326) EIEGLKNQRASLEAVADA  (SEQ ID NO: 625)
       K2C8_DOG NP_001332968 (328) EIETLKNQRAALEAAIADA (SEQ ID NO: 626)
    K2C8_RABBIT XP_008254718 (323) EIEALKGQRATLEAAIADA (SEQ ID NO: 627)
     K2C8_SHEEP XP_012004593 (327) EIEGLKGQRASLEAAIADA (SEQ ID NO: 1341)
              Consensus     (329) EIEGLKGQRASLEAAIADA (SEQ ID NO: 1342)

348             367
       K2C8_HUMAN P05787   (339)  EQRGELAIKDANAKLSELEA (SEQ ID NO: 37)
       K2C8_MOUSE P11679   (345)  EQRGEMAIKDAQTKLAELEA (SEQ ID NO: 628)
         K2C8_RAT Q10758   (339)  EQRGELAVKDANAKLEDLKN (SEQ ID NO: 629)
      K2C8_BOVINE P05786   (346)  EQRGEMAVKDAQAKLAELEA (SEQ ID NO: 630)
      K2C8_PIG NP_001153087 (347) EQRGELAVKDAQAKLAELEA (SEQ ID NO: 631)
     K2C8_HORSE XP_023499379 (345) EQRGELAIKDAQDKVTELEV (SEQ ID NO: 632)
   K2C8_CHICKEN XP_015128103 (341) EERGEMALKDARAKLSELEA (SEQ ID NO: 633)
     K2C8_FELIS XP_003988794 (345) EQRGELAVKDANAKVAELEA (SEQ ID NO: 634)
       K2C8_DOG NP_001332968 (347) EQRGELAVKDANAKVAELEA (SEQ ID NO: 1343)
    K2C8_RABBIT XP_008254718 (342) EQRGELAIKDANAKLAELEA (SEQ ID NO: 635)
     K2C8_SHEEP XP_012004593 (346) EQRGEMAVKDAQAKLAELEA (SEQ ID NO: 1344)
              Consensus     (348) EQRGELAVKDANAKLAELEA (SEQ ID NO: 636)

378             397
       K2C8_HUMAN P05787   (369)  RQLREYQELMNVKLALDIEI (SEQ ID NO: 283)
       K2C8_MOUSE P11679   (375)  RQLREYQELMNVKLALDIEI (SEQ ID NO: 1345)
         K2C8_RAT Q10758   (369)  RQLREYQELMNVKLALDIEI (SEQ ID NO: 1346)
      K2C8_BOVINE P05786   (376)  RQLREYQELMNVKLALDVEI (SEQ ID NO: 637)
      K2C8_PIG NP_001153087 (377) RQLREYQELMNVKLALDVEI (SEQ ID NO: 1347)
     K2C8_HORSE XP_023499379 (375) RQLREYQELMNVKLALDVEI (SEQ ID NO: 1348)
   K2C8_CHICKEN XP_015128103 (371) RQLREYQELMNVKLALDIEI (SEQ ID NO: 1349)
     K2C8_FELIS XP_003988794 (375) RQLREYQELMNVKLALDIEI (SEQ ID NO: 1350)
       K2C8_DOG NP_001332968 (377) RQLREYQELMNVKLALDIEI (SEQ ID NO: 1351)
    K2C8_RABBIT XP_008254718 (372) RQLREYQELMNVKLALDIEI (SEQ ID NO: 1352)
     K2C8_SHEEP XP_012004593 (376) RQLREYQELMNVKLALDVEI (SEQ ID NO: 1353)
              Consensus     (378) RQLREYQELMNVKLALDIEI (SEQ ID NO: 1354)
```

Figure 8 contd

```
                                       380           397
       K2C8_HUMAN P05787     (371) LREYQELMNVKLALDIEI (SEQ ID NO: 29)
       K2C8_MOUSE P11679     (377) LREYQELMNVKLALDIEI (SEQ ID NO: 1355)
         K2C8_RAT Q10758     (371) LREYQELMNVKLALDIEI (SEQ ID NO: 1356)
      K2C8_BOVINE P05786     (378) LREYQELMNVKLALDVEI (SEQ ID NO: 1357)
      K2C8_PIG NP_001153087  (379) LREYQELMNVKLALDVEI (SEQ ID NO: 1358)
     K2C8_HORSE XP_023499379 (377) LREYQELMNVKLALDVEI (SEQ ID NO: 1359)
   K2C8_CHICKEN XP_015128103 (373) LREYQELMNVKLALDIEI (SEQ ID NO: 1360)
     K2C8_FELIS XP_003988794 (377) LREYQELMNVKLALDIEI (SEQ ID NO: 1361)
       K2C8_DOG NP_001332968 (379) LREYQELMNVKLALDIEI (SEQ ID NO: 1362)
    K2C8_RABBIT XP_008254718 (374) LREYQELMNVKLALDIEI (SEQ ID NO: 1363)
     K2C8_SHEEP XP_012004593 (378) LREYQELMNVKLALDVEI (SEQ ID NO: 1364)
               Consensus     (380) LREYQELMNVKLALDIEI (SEQ ID NO: 1365)

390           408
       K2C8_HUMAN P05787     (381) KLALDIEIATYRKLLEGEE (SEQ ID NO: 30)
       K2C8_MOUSE P11679     (387) KLALDIEITTYRKLLEGEE (SEQ ID NO: 639)
         K2C8_RAT Q10758     (381) KLALDIEIATYRKLLEGEE (SEQ ID NO: 1366)
      K2C8_BOVINE P05786     (388) KLALDVEIATYRKLLEGEE (SEQ ID NO: 640)
      K2C8_PIG NP_001153087  (389) KLALDVEIATYRKLLEGEE (SEQ ID NO: 1367)
     K2C8_HORSE XP_023499379 (387) KLALDVEIATYRKLLEGEE (SEQ ID NO: 1368)
   K2C8_CHICKEN XP_015128103 (383) KLALDIEIATYRKLLEGEE (SEQ ID NO: 1369)
     K2C8_FELIS XP_003988794 (387) KLALDIEIATYRKLLEGEE (SEQ ID NO: 1370)
       K2C8_DOG NP_001332968 (389) KLALDIEIATYRKLLEGEE (SEQ ID NO: 1371)
    K2C8_RABBIT XP_008254718 (384) KLALDIEIATYRKLLEGEE (SEQ ID NO: 1372)
     K2C8_SHEEP XP_012004593 (388) KLALDVEIATYRKLLEGEE (SEQ ID NO: 1373)
               Consensus     (390) KLALDIEIATYRKLLEGEE (SEQ ID NO: 1374)
```

Figure 8g. Homology of Human Nucleophosmin epitopes with other species

```
                                     13          29
        NPM_HUMAN P06748     (11) PLRPQNYLFGCELKADK (SEQ ID NO: 48)
        NPM_MOUSE Q61937     (11) PLRPQNYLFGCELKADK (SEQ ID NO: 1375)
          NPM_RAT P13084     (11) PLRPQNYLFGCELKADK (SEQ ID NO: 1376)
       NPM_BOVINE Q3T160     (11) PLRPQNYLFGCELKADR (SEQ ID NO: 641)
      NPM_PIG XP_013846116   (11) PLRPQNYLFGCELKADK (SEQ ID NO: 1377)
     NPM_HORSE XP_005615050  (11) PLRPQNYLFGCELKADK (SEQ ID NO: 1378)
      NPM_CHICKEN P16039     (13) PLRPQTFLFGCELKAEK (SEQ ID NO: 642)
     NPM_FELIS XP_003981326  (11) PLRPQNYLFGCELKADK (SEQ ID NO: 1379)
       NPM_DOG NP_001239100  (11) PLRPQNYLFGCELKADK (SEQ ID NO: 1380)
    NPM_RABBIT XP_008253606  (11) PLRPQNYLFGCELKADK (SEQ ID NO: 1381)
     NPM_SHEEP XP_004002901  (11) PLRPQNYLFGCELKADR (SEQ ID NO: 1382)
               Consensus     (13) PLRPQNYLFGCELKADK (SEQ ID NO: 1383)
```

Figure 8 contd

```
                                         70                  91
      NPM_HUMAN P06748    (68) EGSPIKVTLATLKMSVQPTVSL (SEQ ID NO: 49)
      NPM_MOUSE Q61937    (68) EGSPIKVTLATLKMSVQPTVSL (SEQ ID NO: 1384)
        NPM_RAT P13084    (68) EGSPIKVTLATLKMSVQPTVSL (SEQ ID NO: 1385)
     NPM_BOVINE Q3T160    (68) EGSPIKVTLATLKMSVQPTVSL (SEQ ID NO: 1386)
     NPM_PIG XP_013846116 (68) EGSPIKVTLATLKMSVQPTVSL (SEQ ID NO: 1387)
   NPM_HORSE XP_005615050 (68) EGSPIKVTLATLKMSVQPTVSL (SEQ ID NO: 1388)
    NPM_CHICKEN P16039    (70) EGNPTKVVLASLKMSVQPTVSL (SEQ ID NO: 643)
   NPM_FELIS XP_003981326 (68) EGSPIKVTLATLKMSVQPTVSL (SEQ ID NO: 1389)
     NPM_DOG NP_001239100 (68) EGSPIKVTLATLKMSVQPTVSL (SEQ ID NO: 1390)
  NPM_RABBIT XP_008253606 (68) EGSPIKVTLATLKMSVQPTVSL (SEQ ID NO: 1391)
   NPM_SHEEP XP_004002901 (68) EGSPIKVTLATLKMSVQPTVSL (SEQ ID NO: 1392)
               Consensus  (70) EGSPIKVTLATLKMSVQPTVSL (SEQ ID NO: 1393)

131                 151
      NPM_HUMAN P06748   (129) EEEDVKLLSISGKRSAPGGGS (SEQ ID NO: 50)
      NPM_MOUSE Q61937   (129) DEEDVKLLGMSGKRSAPGGGN (SEQ ID NO: 644)
        NPM_RAT P13084   (129) DEEDVKLLGMSGKRSAPGGGN (SEQ ID NO: 1394)
     NPM_BOVINE Q3T160   (129) EEEEVKLLSISGKRSAPGSGS (SEQ ID NO: 645)
     NPM_PIG XP_013846116 (129) EEEDVKLLSISGKRSAPGGGS (SEQ ID NO: 1395)
   NPM_HORSE XP_005615050 (129) EEEDVKLLSISGKRSAPGSGS (SEQ ID NO: 646)
    NPM_CHICKEN P16039   (130) EEEDTKIGNASTKRPASGGGA (SEQ ID NO: 647)
   NPM_FELIS XP_003981326 (129) EEEDVKLLSISGKRSAPGSGS (SEQ ID NO: 1396)
     NPM_DOG NP_001239100 (129) EEEDVKLLSISGKRSAPGSGS (SEQ ID NO: 1397)
  NPM_RABBIT XP_008253606 (129) EEEDVKLLSISGKRSAPGGGS (SEQ ID NO: 1398)
   NPM_SHEEP XP_004002901 (129) EEEEVKLLSISGKRSAPGSGS (SEQ ID NO: 1399)
               Consensus (131) EEEDVKLLSISGKRSAPGGGS (SEQ ID NO: 1400)

225                 245
      NPM_HUMAN P06748   (222) SKGQESFKKQEK--TPKTPKG (SEQ ID NO: 51)
      NPM_MOUSE Q61937   (220) SKGQESFKKQEK--TPKTPKG (SEQ ID NO: 1401)
        NPM_RAT P13084   (220) SKGQESFKKQEK--TPKTPKG (SEQ ID NO: 1402)
     NPM_BOVINE Q3T160   (222) SKGQESFKKQEK--TPKTPRG (SEQ ID NO: 1403)
     NPM_PIG XP_013846116 (222) SKGQESFKKQEK--TPKTPKG (SEQ ID NO: 1404)
   NPM_HORSE XP_005615050 (222) SKGQESFKKQEK--TPKTPKG (SEQ ID NO: 1405)
    NPM_CHICKEN P16039   (220) SKTKTPDSKKDKSLTPKTPV  (SEQ ID NO: 649)
   NPM_FELIS XP_003981326 (222) SKGQESFKKQEK--TPKTPKG (SEQ ID NO: 1406)
     NPM_DOG NP_001239100 (222) TKGQESFKKQEK--TPKTPKG (SEQ ID NO: 650)
  NPM_RABBIT XP_008253606 (222) SKGQESFKKQEK--TPKTPKG (SEQ ID NO: 1407)
   NPM_SHEEP XP_004002901 (222) SKGQESFKKQEK--TPKTPKG (SEQ ID NO: 1408)
               Consensus (225) SKGQESFKKQEK  TPKTPKG (SEQ ID NO: 1409)

263                 282
      NPM_HUMAN P06748   (258) GGSLPKVEAKFINYVKNCFR (SEQ ID NO: 52)
      NPM_MOUSE Q61937   (256) GGSLPKVEAKFINYVKNCFR (SEQ ID NO: 1410)
        NPM_RAT P13084   (256) GGSLPKVEAKFINYVKNCFR (SEQ ID NO: 1411)
     NPM_BOVINE Q3T160   (258) GGSLPKVEAKFINYVKNCFR (SEQ ID NO: 1412)
     NPM_PIG XP_013846116 (258) GGSLPKVEAKFINYVKNCFR (SEQ ID NO: 1413)
   NPM_HORSE XP_005615050 (258) GGSLPKVEAKFINYVKNCFR (SEQ ID NO: 1414)
    NPM_CHICKEN P16039   (258) GCSLPKLEPKFANYVKNCFR (SEQ ID NO: 651)
   NPM_FELIS XP_003981326 (258) GGSLPKVEAKFINYVKNCFR (SEQ ID NO: 1415)
     NPM_DOG NP_001239100 (258) GGSLPKVEAKFINYVKNCFR (SEQ ID NO: 1416)
  NPM_RABBIT XP_008253606 (258) GGSLPKVEAKFINYVKNCFR (SEQ ID NO: 1417)
   NPM_SHEEP XP_004002901 (258) GGSLPKVEAKFINYVKNCFR (SEQ ID NO: 1418)
               Consensus (263) GGSLPKVEAKFINYVKNCFR (SEQ ID NO: 1419)
```

Figure 8 contd

```
                                         271              292
      NPM_HUMAN P06748   (266) AKFINYVKNCFRMTDQEAIQDL (SEQ ID NO: 53)
      NPM_MOUSE Q61937   (264) AKFINYVKNCFRMTDQEAIQDL (SEQ ID NO: 1420)
        NPM_RAT P13084   (264) AKFINYVKNCFRMTDQEAIQDL (SEQ ID NO: 1421)
     NPM_BOVINE Q3T160   (266) AKFINYVKNCFRMTDQEAIQDL (SEQ ID NO: 1422)
   NPM_PIG XP_013846116  (266) AKFINYVKNCFRMTDQEAIQDL (SEQ ID NO: 1423)
 NPM_HORSE XP_005615050  (266) AKFINYVKNCFRMTDQEAIQDL (SEQ ID NO: 1424)
    NPM_CHICKEN P16039   (266) PKFANYVKNCFRTEDQKVIQAL (SEQ ID NO: 652)
 NPM_FELIS XP_003981326  (266) AKFINYVKNCFRMTDQEAIQDL (SEQ ID NO: 1425)
      NPM_DOG NP_001239100 (266) AKFINYVKNCFRMTDQEAIQDL (SEQ ID NO: 1426)
NPM_RABBIT XP_008253606  (266) AKFINYVKNCFRMTDQEAIQDL (SEQ ID NO: 1427)
 NPM_SHEEP XP_004002901  (266) AKFINYVKNCFRMTDQEAIQDL (SEQ ID NO: 1428)
              Consensus  (271) AKFINYVKNCFRMTDQEAIQDL (SEQ ID NO: 1429)
```

Figure 8h. Homology of Human Heat Shock Protein 60 epitopes with other species

```
                                          84             103
      CH60_HUMAN P10809   (84) IDLKDKYKNIGAKLVQDVAN (SEQ ID NO: 77)
      CH60_MOUSE P63038   (84) IDLKDKYKNIGAKLVQDVAN (SEQ ID NO: 1430)
        CH60_RAT P63039   (84) IDLKDKYKNIGAKLVQDVAN (SEQ ID NO: 1431)
     CH60_BOVINE P31081   (84) IDLKDKYKNIGAKLVQDVAN (SEQ ID NO: 1432)
   CH60_PIG NP_001241645  (84) IDLKDKYKNIGAKLVQDVAN (SEQ ID NO: 1433)
 CH60_HORSE XP_023478052  (84) IDLKDKYKNIGAKLVQDVAN (SEQ ID NO: 1434)
    CH60_CHICKEN Q5ZL72   (84) IDLKDKYKNIGAKLVQDVAN (SEQ ID NO: 1435)
 CH60_FELIS XP_003991044  (84) IDLKDKYKNIGAKLVQDVAN (SEQ ID NO: 1436)
   CH60_DOG XP_005640553  (84) IDLKDKYKNIGAKLVQDVAN (SEQ ID NO: 1437)
CH60_RABBIT XP_002712414  (84) IDLKDKYKNIGAKLVQDVAN (SEQ ID NO: 1438)
 CH60_SHEEP XP_004004841  (84) IDLKDKYKNIGAKLVQDVAN (SEQ ID NO: 1439)
              Consensus   (84) IDLKDKYKNIGAKLVQDVAN (SEQ ID NO: 1440)

117             136
      CH60_HUMAN P10809  (117) TVLARSIAKEGFEKISKGAN (SEQ ID NO: 78)
      CH60_MOUSE P63038  (117) TVLARSIAKEGFEKISKGAN (SEQ ID NO: 1441)
        CH60_RAT P63039  (117) TVLARSIAKEGFEKISKGAN (SEQ ID NO: 1442)
     CH60_BOVINE P31081  (117) TVLARSIAKEGFEKISKGAN (SEQ ID NO: 1443)
   CH60_PIG NP_001241645 (117) TVLACSIAKEGFEKISKGAN (SEQ ID NO: 653)
 CH60_HORSE XP_023478052 (117) TVLARSIAKEGFEKISKGAN (SEQ ID NO: 1444)
    CH60_CHICKEN Q5ZL72  (117) TVLARAIAKEGFEKISKGAN (SEQ ID NO: 654)
 CH60_FELIS XP_003991044 (117) TVLARSIAKEGFEKISKGAN (SEQ ID NO: 1445)
   CH60_DOG XP_005640553 (117) TVLARSIAKEGFEKISKGAN (SEQ ID NO: 1446)
CH60_RABBIT XP_002712414 (117) TVLARSIAKEGFEKISKGAN (SEQ ID NO: 1447)
 CH60_SHEEP XP_004004841 (117) TVLARSIAKEGFEKISKGAN (SEQ ID NO: 1448)
              Consensus  (117) TVLARSIAKEGFEKISKGAN (SEQ ID NO: 1449)
```

Figure 8 contd

```
                                    208              226
      CH60_HUMAN P10809       (208) NDELEIIEGMKFDRGYISP (SEQ ID NO: 655)
      CH60_MOUSE P63038       (208) NDELEIIEGMKFDRGYISP (SEQ ID NO: 1450)
        CH60_RAT P63039       (208) NDELEIIEGMKFDRGYISP (SEQ ID NO: 1451)
     CH60_BOVINE P31081       (208) NDELEIIEGMKFDRGYISP (SEQ ID NO: 1452)
    CH60_PIG NP_001241645     (208) NDELEIIEGMKLYRGYISP (SEQ ID NO: 1453)
   CH60_HORSE XP_023478052    (208) NDELEIIEGMKFDRGYISP (SEQ ID NO: 1454)
     CH60_CHICKEN Q5ZL72      (208) NDELEIIEGMKFDRGYISP (SEQ ID NO: 1455)
   CH60_FELIS XP_003991044    (208) NDELEIIEGMKFDRGYISP (SEQ ID NO: 1456)
     CH60_DOG XP_005640553    (208) NDELEIIEGMKFDRGYISP (SEQ ID NO: 1457)
  CH60_RABBIT XP_002712414    (208) NDELEIIEGMKFDRGYISP (SEQ ID NO: 1458)
   CH60_SHEEP XP_004004841    (208) NDELEIIEGMKFDRGYISP (SEQ ID NO: 1459)
                Consensus     (208) NDELEIIEGMKFDRGYISP (SEQ ID NO: 1460)

280              299
      CH60_HUMAN P10809       (280) GEALSTLVLNRLKVGLQVVA (SEQ ID NO: 79)
      CH60_MOUSE P63038       (280) GEALSTLVLNRLKVGLQVVA (SEQ ID NO: 1461)
        CH60_RAT P63039       (280) GEALSTLVLNRLKVGLQVVA (SEQ ID NO: 1462)
     CH60_BOVINE P31081       (280) GEALSTLVLNRLKVGLQVVA (SEQ ID NO: 1463)
    CH60_PIG NP_001241645     (280) GEALSTLVLNRLKVGLQVVA (SEQ ID NO: 1464)
   CH60_HORSE XP_023478052    (280) GEALSTLVLNRLKVGLQVVA (SEQ ID NO: 1465)
     CH60_CHICKEN Q5ZL72      (280) GEALSTLVLNRLKVGLQVVA (SEQ ID NO: 1466)
   CH60_FELIS XP_003991044    (280) GEALSTLVLNRLKVGLQVVA (SEQ ID NO: 1467)
     CH60_DOG XP_005640553    (280) GEALSTLVLNRLKVGLQVVA (SEQ ID NO: 1468)
  CH60_RABBIT XP_002712414    (280) GEALSTLVLNRLKVGLQVVA (SEQ ID NO: 1469)
   CH60_SHEEP XP_004004841    (280) GEALSTLVLNRLKVGLQVVA (SEQ ID NO: 1470)
                Consensus     (280) GEALSTLVLNRLKVGLQVVA (SEQ ID NO: 1471)

374              393
      CH60_HUMAN P10809       (374) IIEQLDVTTSEYEKEKLNER (SEQ ID NO: 657)
      CH60_MOUSE P63038       (374) ITEQLDITTSEYEKEKLNER (SEQ ID NO: 658)
        CH60_RAT P63039       (374) ITEQLDITTSEYEKEKLNER (SEQ ID NO: 1472)
     CH60_BOVINE P31081       (374) IIEQLDITTSEYEKEKLNER (SEQ ID NO: 659)
    CH60_PIG NP_001241645     (374) IIEQLDVTTSEYEKEKLNER (SEQ ID NO: 1473)
   CH60_HORSE XP_023478052    (374) IIEQLDVTTSEYEKEKLNER (SEQ ID NO: 1474)
     CH60_CHICKEN Q5ZL72      (374) IIEQLEVTTSEYEKEKLNER (SEQ ID NO: 660)
   CH60_FELIS XP_003991044    (374) IIEQLDITTSEYEKEKLNER (SEQ ID NO: 1475)
     CH60_DOG XP_005640553    (374) IIEQLDITTSEYEKEKLNER (SEQ ID NO: 1476)
  CH60_RABBIT XP_002712414    (374) IIEQLDITTSEYEKEKLNER (SEQ ID NO: 1477)
   CH60_SHEEP XP_004004841    (374) IIEQLDVTTSEYEKEKLNER (SEQ ID NO: 1478)
                Consensus     (374) IIEQLDITTSEYEKEKLNER (SEQ ID NO: 1479)
```

Figure 8 contd

```
                                        381              398
        CH60_HUMAN P10809        (381)  TTSEYEKEKLNERLAKLS  (SEQ ID NO: 80)
        CH60_MOUSE P63038        (381)  TTSEYEKEKLNERLAKLS  (SEQ ID NO: 1480)
          CH60_RAT P63039        (381)  TTSEYEKEKLNERLAKLS  (SEQ ID NO: 1481)
       CH60_BOVINE P31081        (381)  TTSEYEKEKLNERLAKLS  (SEQ ID NO: 1482)
       CH60_PIG NP_001241645     (381)  TTSEYEKEKLNERLAKLS  (SEQ ID NO: 1483)
     CH60_HORSE XP_023478052     (381)  TTSEYEKEKLNERLAKLS  (SEQ ID NO: 1484)
        CH60_CHICKEN Q5ZL72      (381)  TTSEYEKEKLNERLAKLS  (SEQ ID NO: 1485)
     CH60_FELIS XP_003991044     (381)  TTSEYEKEKLNERLAKLS  (SEQ ID NO: 1486)
       CH60_DOG XP_005640553     (381)  TTSEYEKEKLNERLAKLS  (SEQ ID NO: 1487)
    CH60_RABBIT XP_002712414     (381)  TTSEYEKEKLNERLAKLS  (SEQ ID NO: 1488)
     CH60_SHEEP XP_004004841     (381)  TTSEYEKEKLNERLAKLS  (SEQ ID NO: 1489)
                   Consensus     (381)  TTSEYEKEKLNERLAKLS  (SEQ ID NO: 1490)

517                536
        CH60_HUMAN P10809        (517)  GIIDPTKVVRTALLDAAGVA  (SEQ ID NO: 661)
        CH60_MOUSE P63038        (517)  GIIDPTKVVRTALLDAAGVA  (SEQ ID NO: 1491)
          CH60_RAT P63039        (517)  GIIDPTKVVRTALLDAAGVA  (SEQ ID NO: 1492)
       CH60_BOVINE P31081        (517)  GIIDPTKVVRTALLDAAGVA  (SEQ ID NO: 1493)
       CH60_PIG NP_001241645     (517)  GIIDPTKVVRTALLDAAGVA  (SEQ ID NO: 1494)
     CH60_HORSE XP_023478052     (517)  GIIDPTKVVRTALLDAAGVA  (SEQ ID NO: 1495)
        CH60_CHICKEN Q5ZL72      (517)  GIIDPTKVVRTALMDAAGVA  (SEQ ID NO: 662)
     CH60_FELIS XP_003991044     (517)  GIIDPTKVVRTALLDAAGVA  (SEQ ID NO: 1496)
       CH60_DOG XP_005640553     (517)  GIIDPTKVVRTALLDAAGVA  (SEQ ID NO: 1497)
    CH60_RABBIT XP_002712414     (517)  GIIDPTKVVRTALLDAAGVA  (SEQ ID NO: 1498)
     CH60_SHEEP XP_004004841     (517)  GIIDPTKVVRTALLDAAGVA  (SEQ ID NO: 1499)
                   Consensus     (517)  GIIDPTKVVRTALLDAAGVA  (SEQ ID NO: 1500)
```

Figure 9
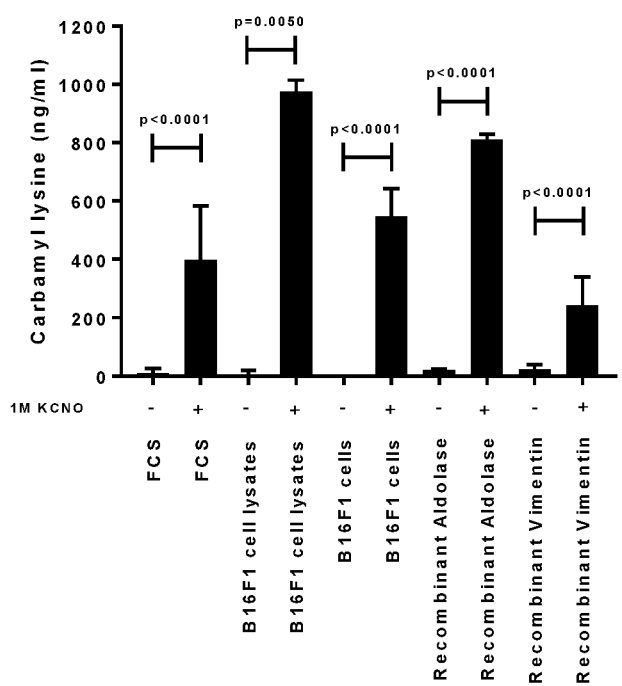
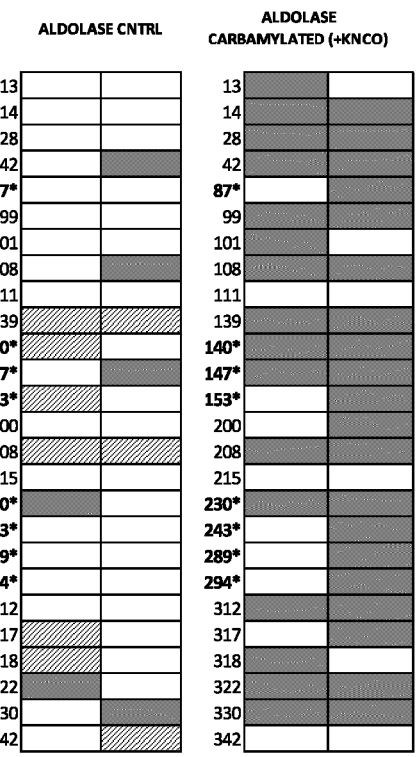
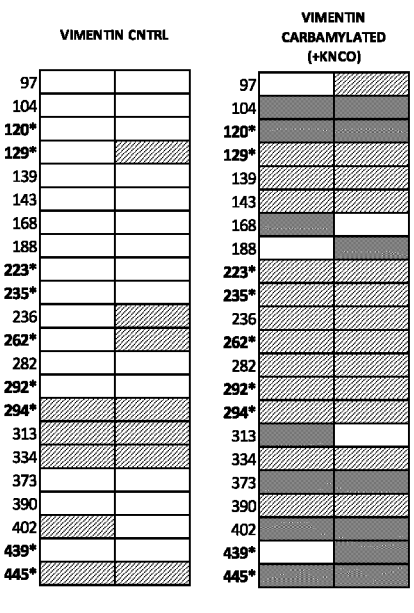

Figure 11:
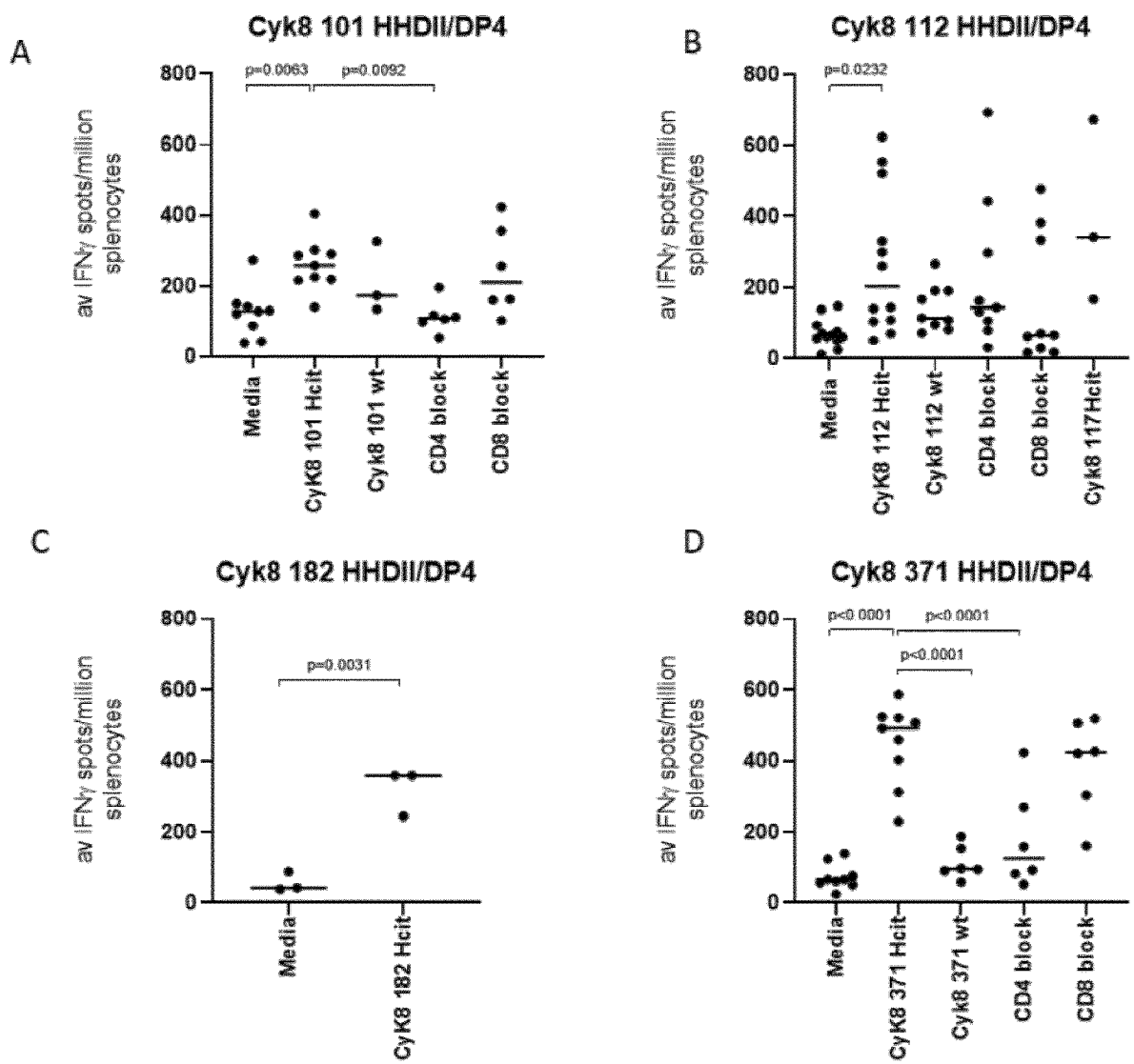

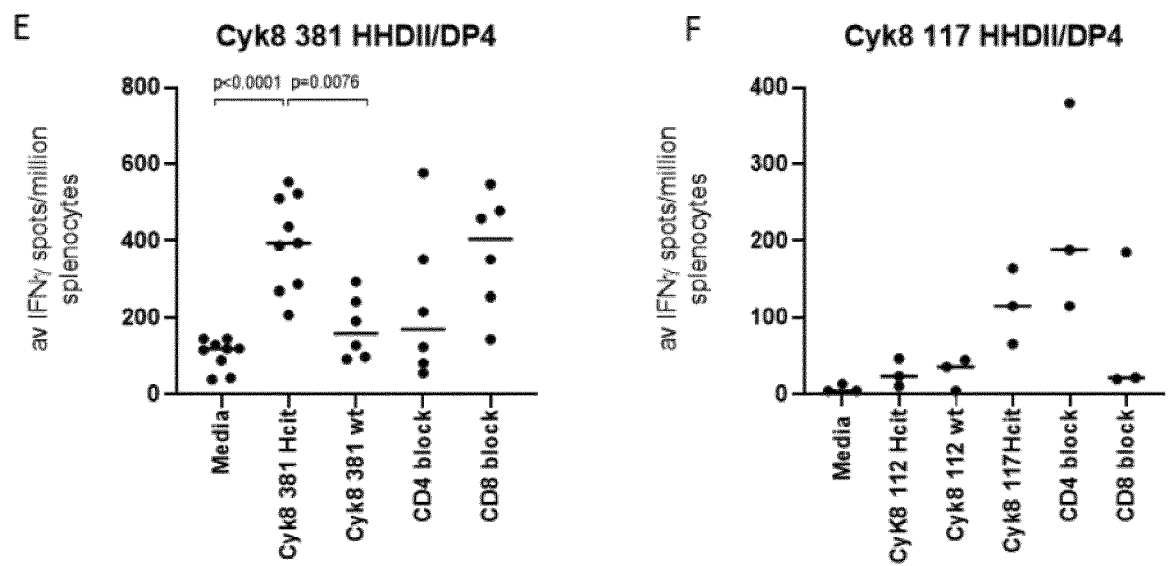
Figure 11 contd

Figure 12:
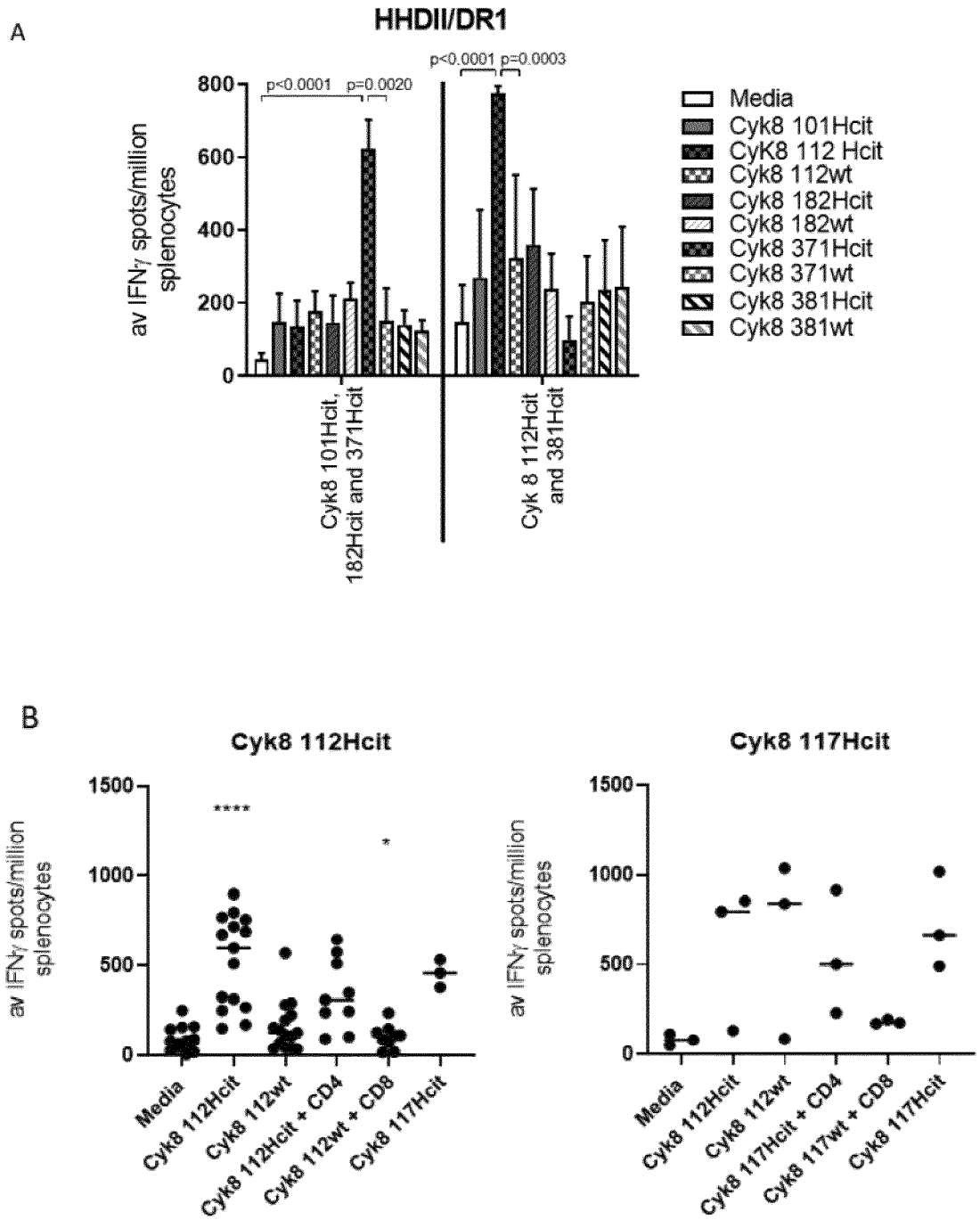

Figure 12 contd
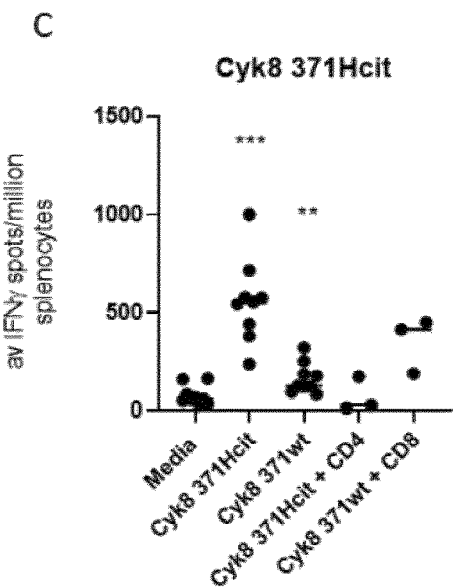
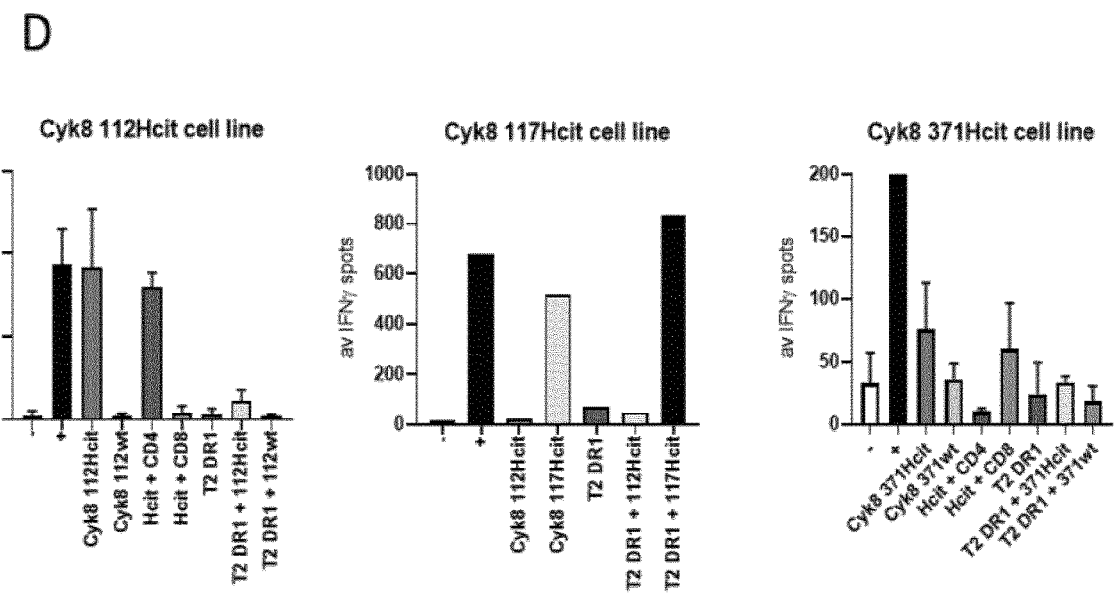

Figure 12 contd
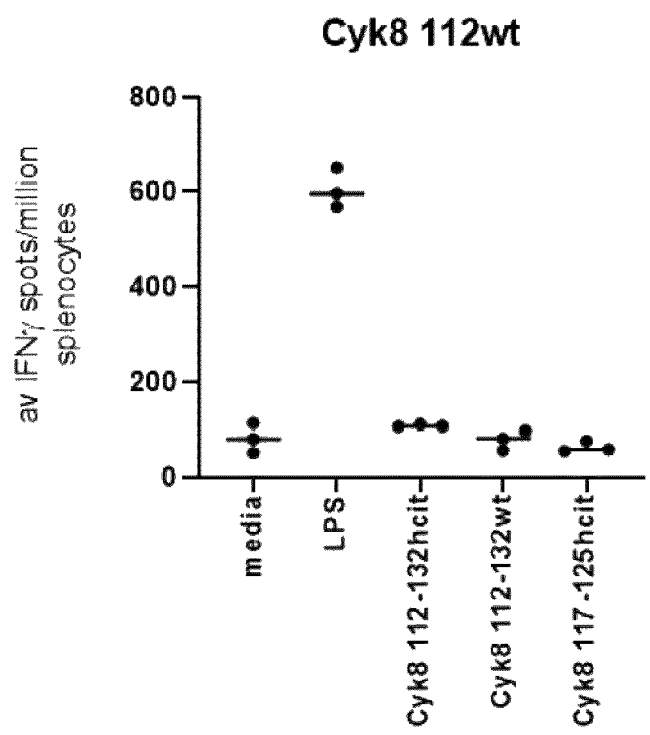

Figure 13:
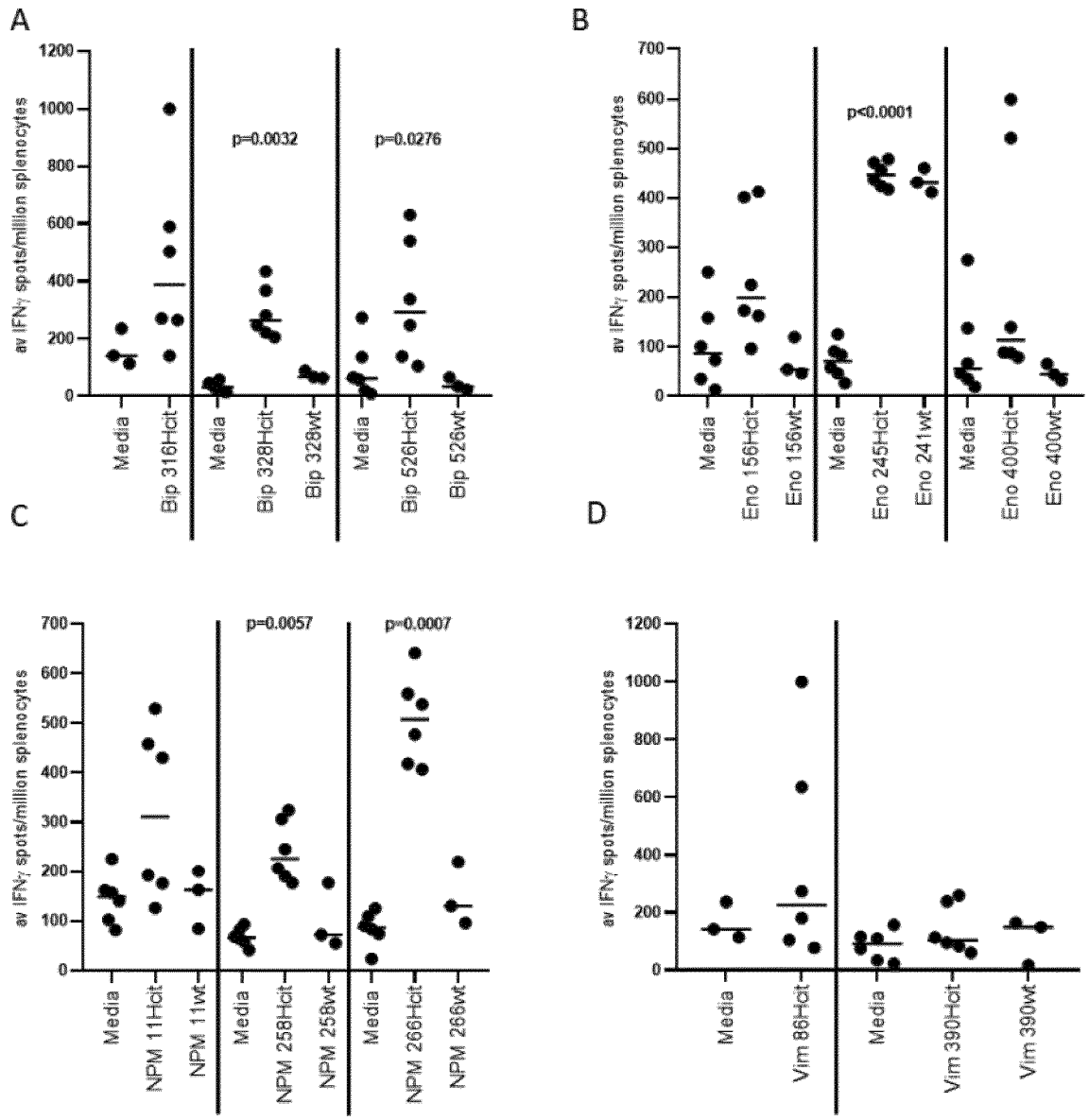

Figure 13 contd
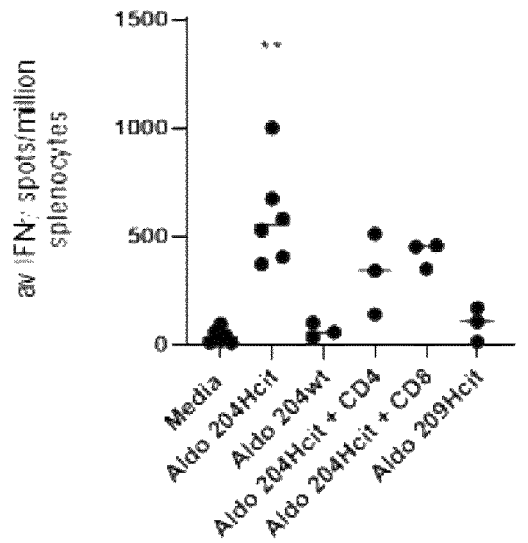
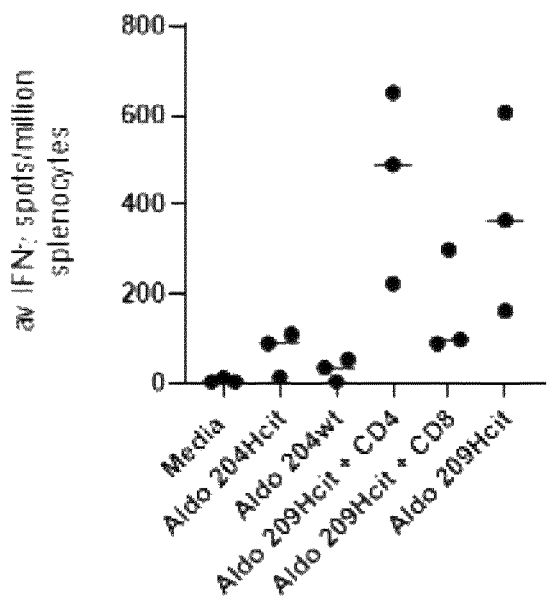

Figure 16:
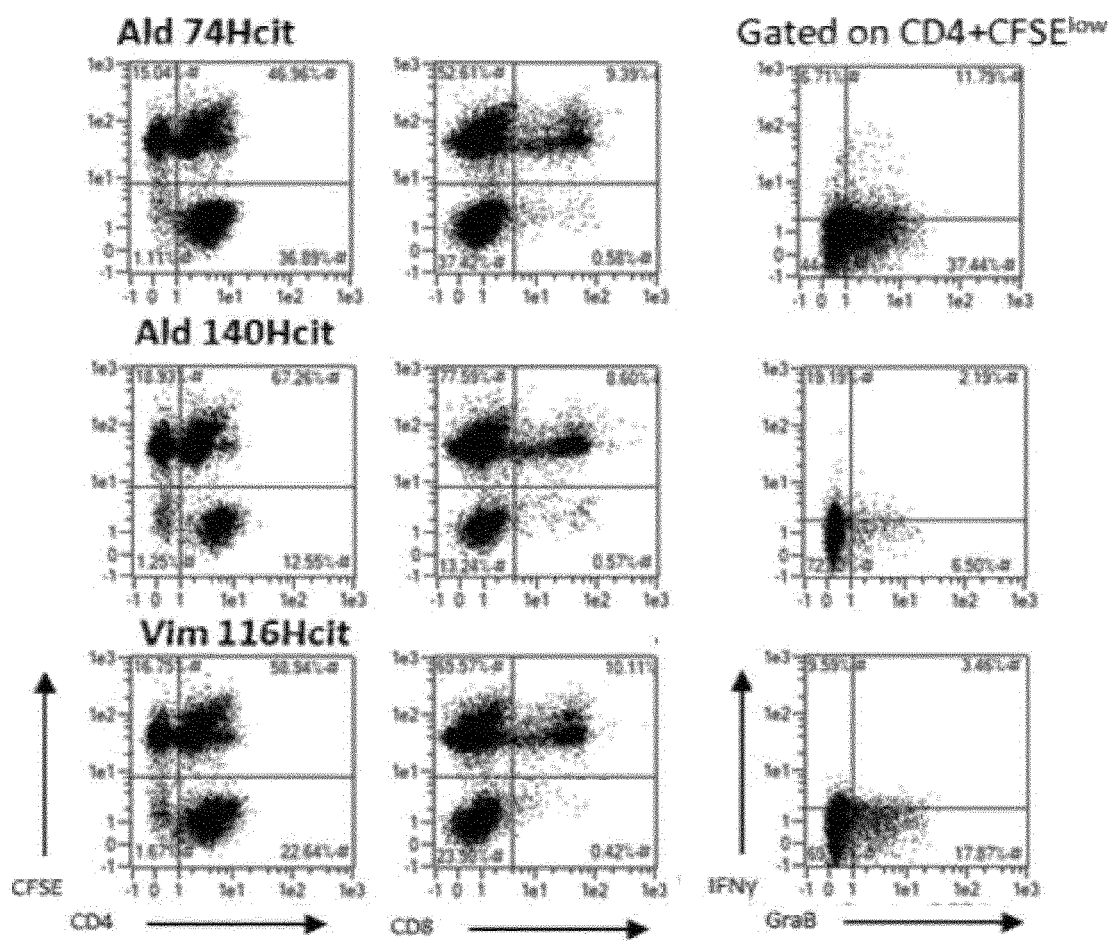

Figure 16 contd
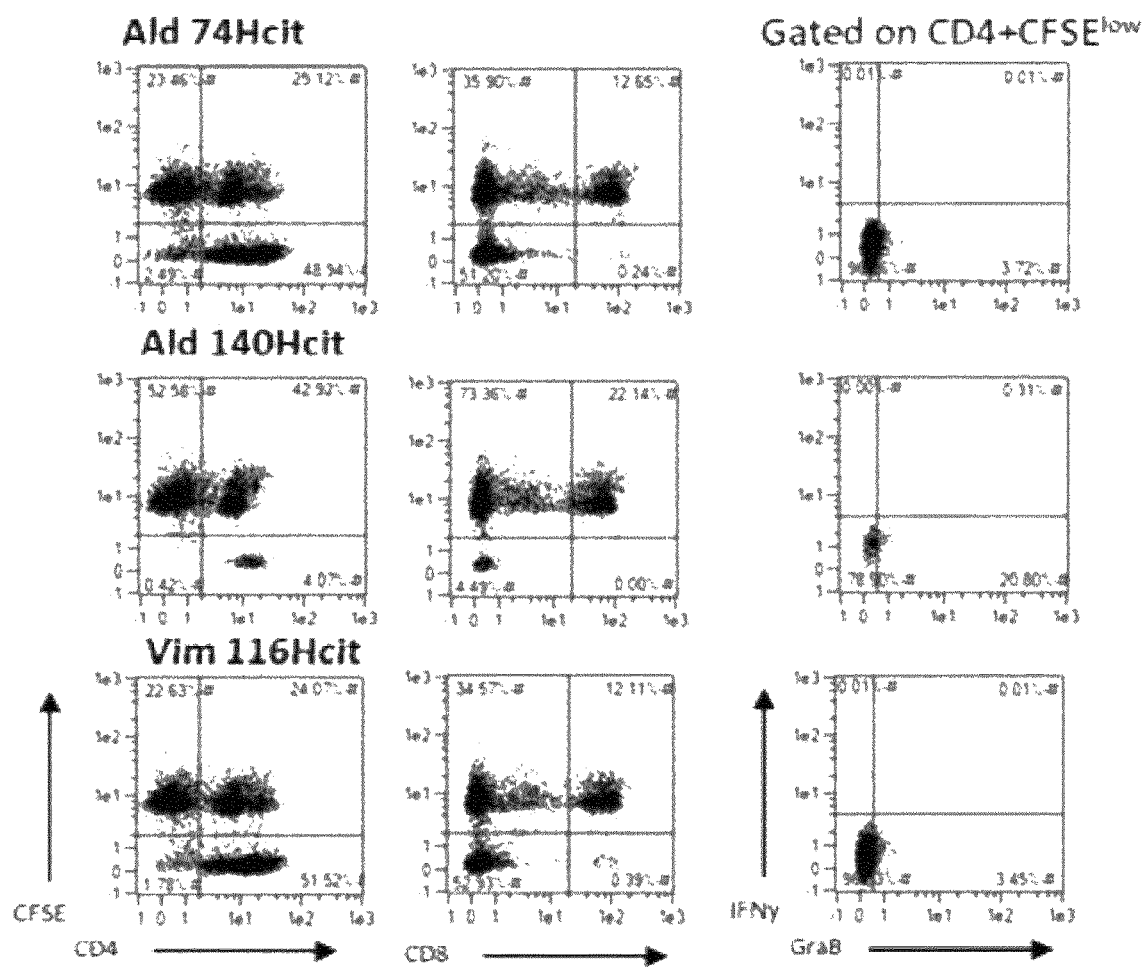

Figure 16 contd
C
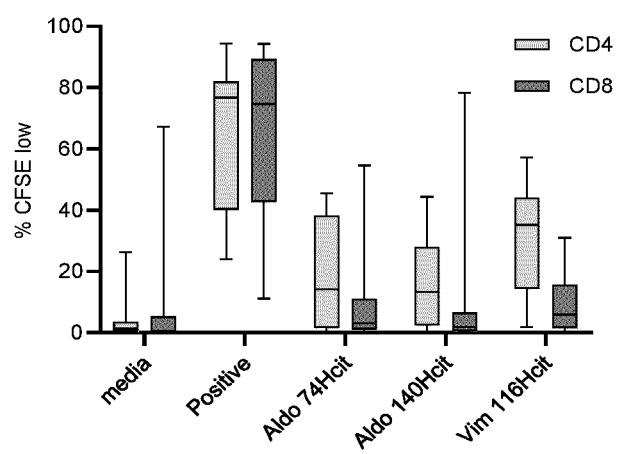
D
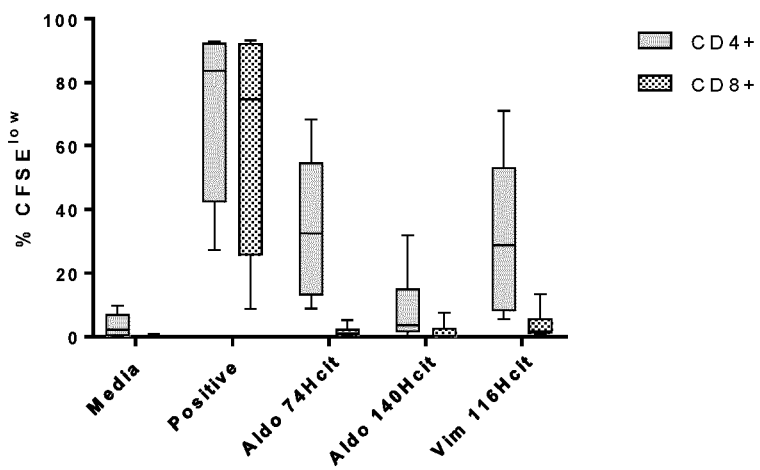

Figure 16 contd
E
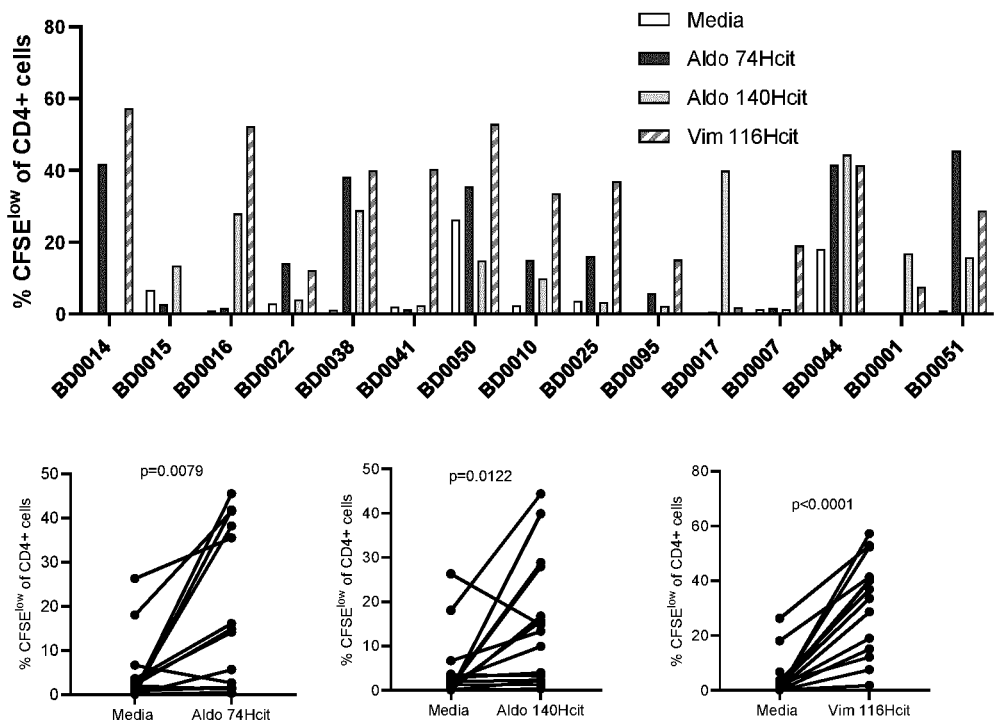
F
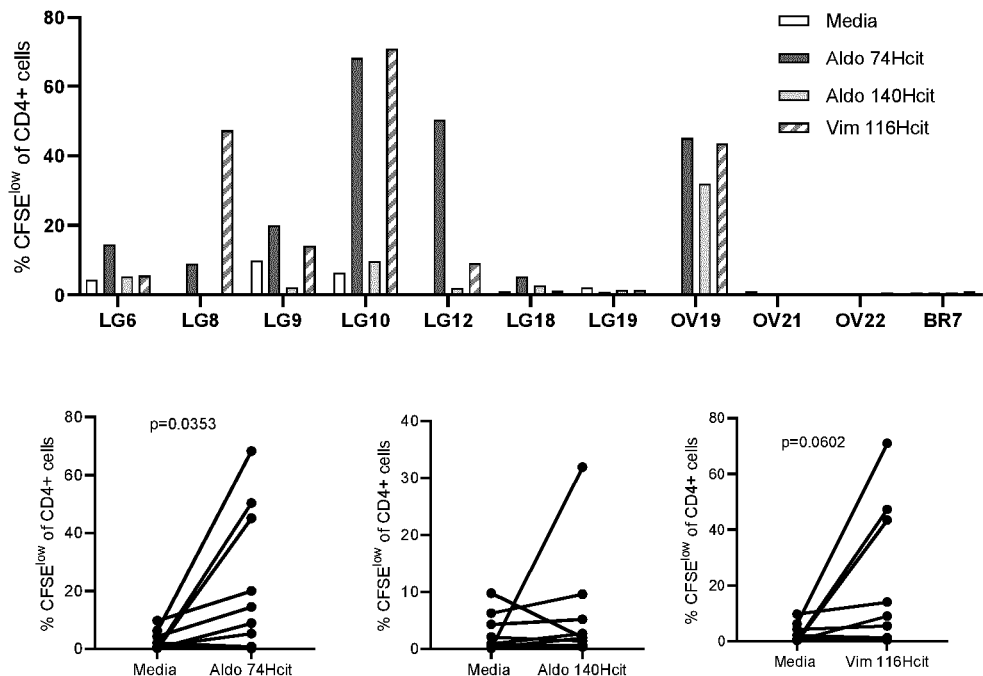

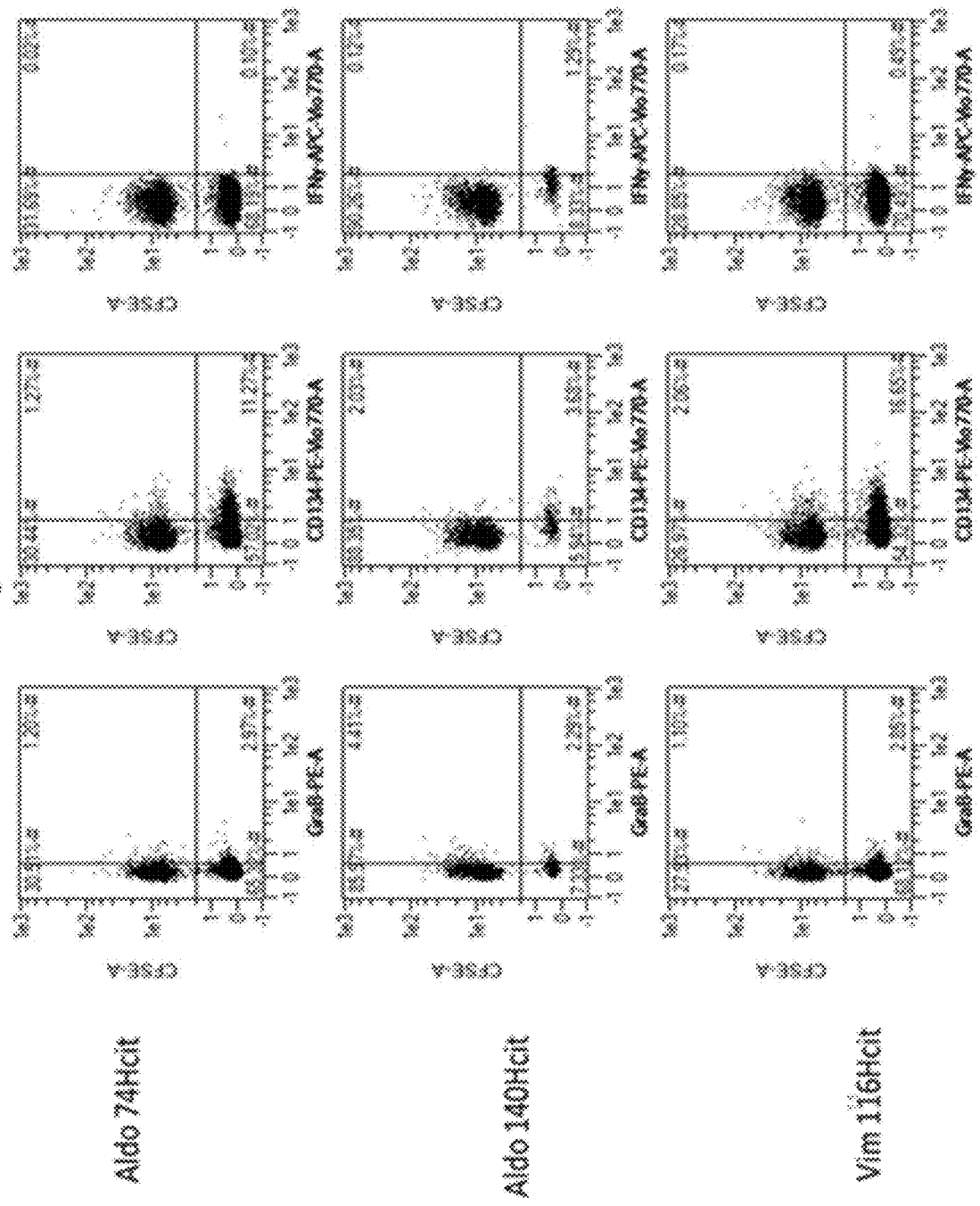

Figure 17:
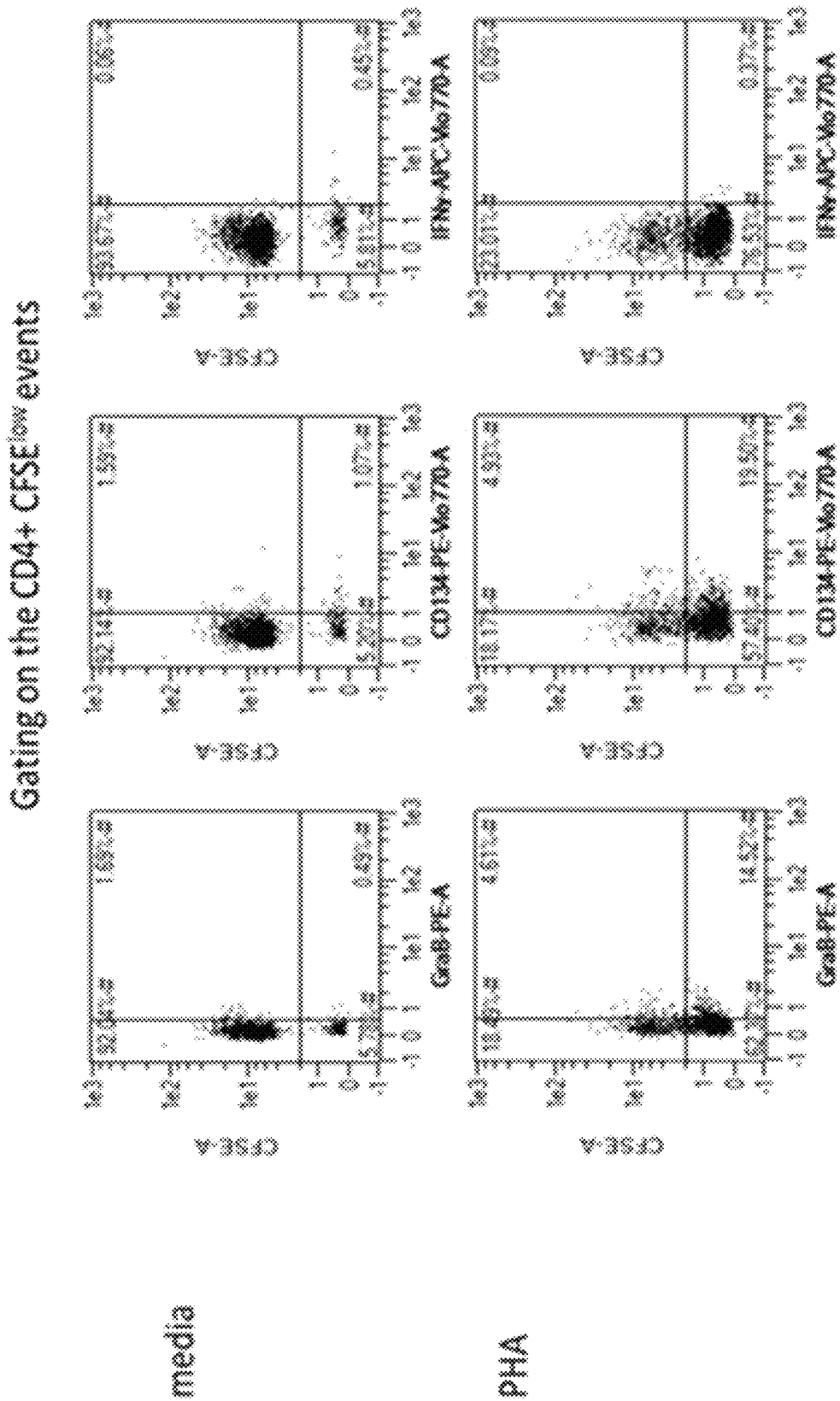

Figure 17 contd
B
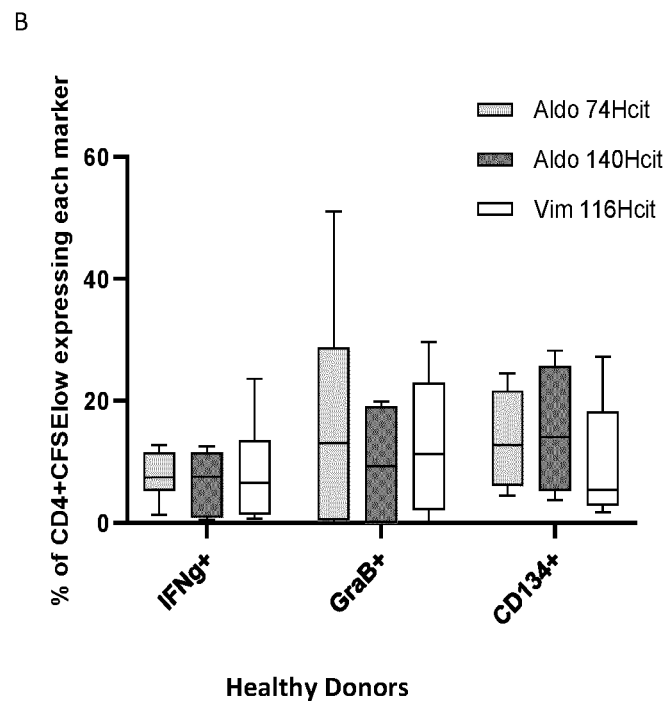
Healthy Donors
C
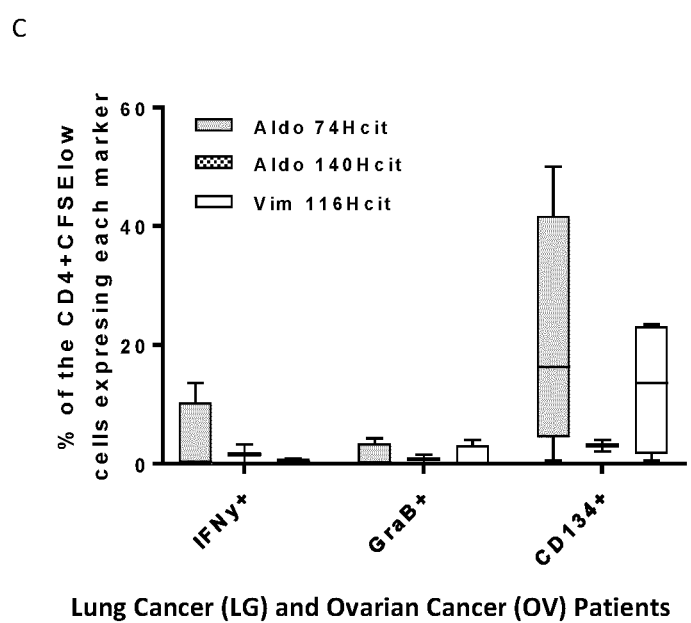
Lung Cancer (LG) and Ovarian Cancer (OV) Patients

Figure 19:
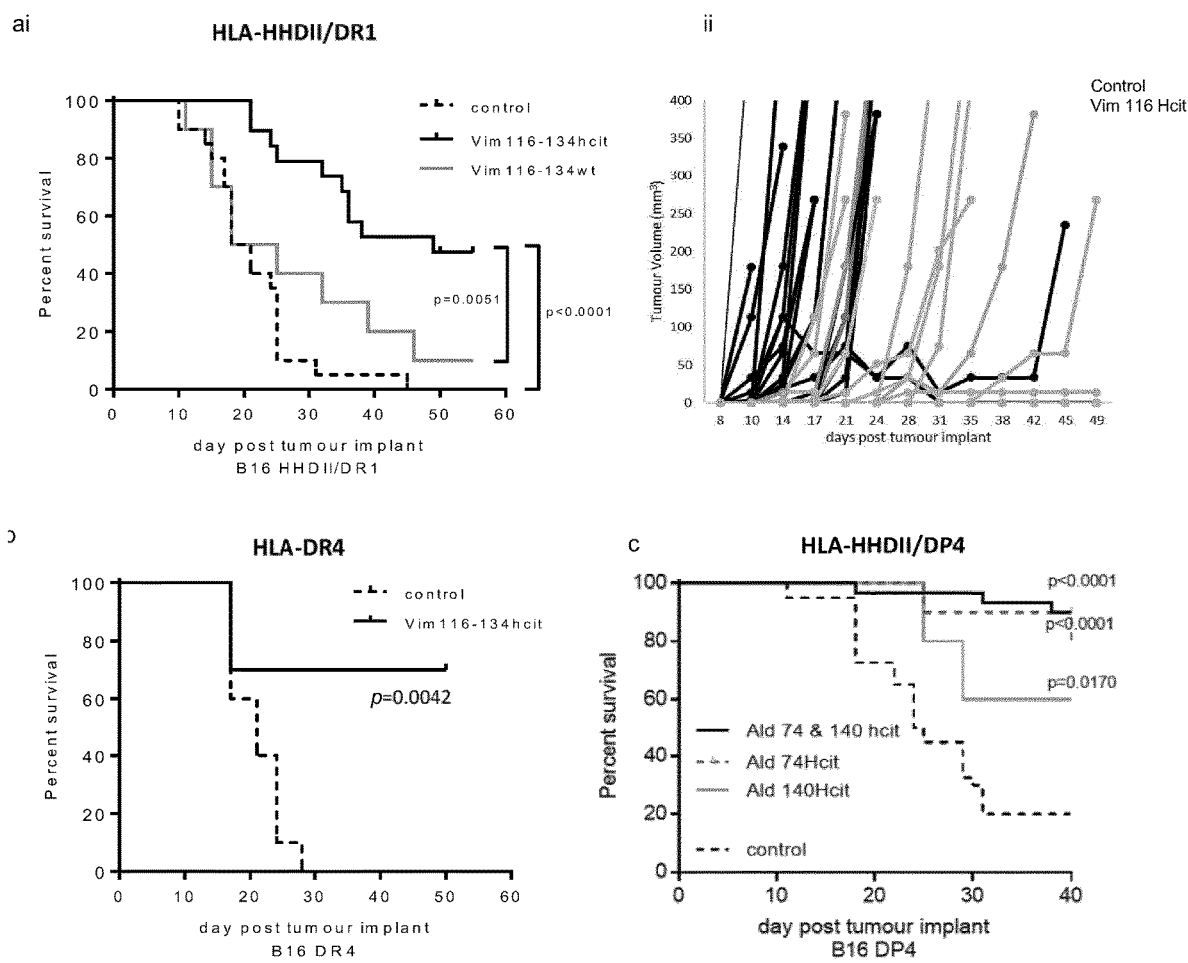

Figure 19 contd
d
HLA-HHDII/DR1
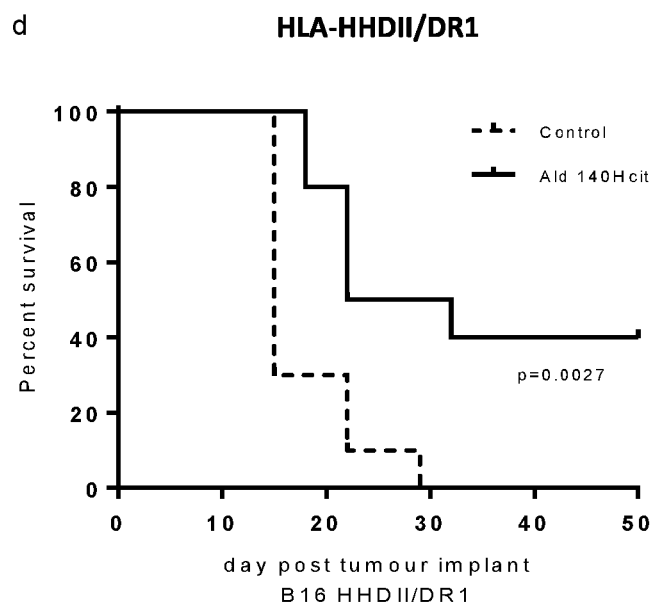
e
HLA-DR4
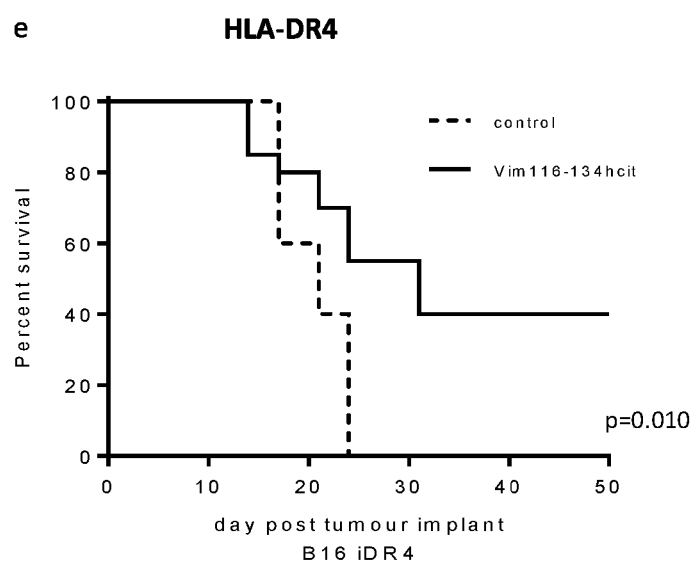

Figure 21
A
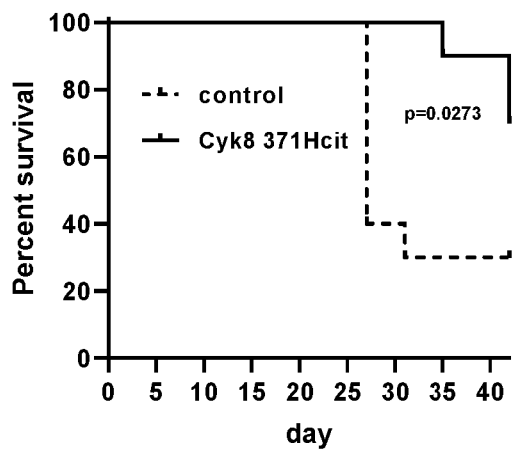
B
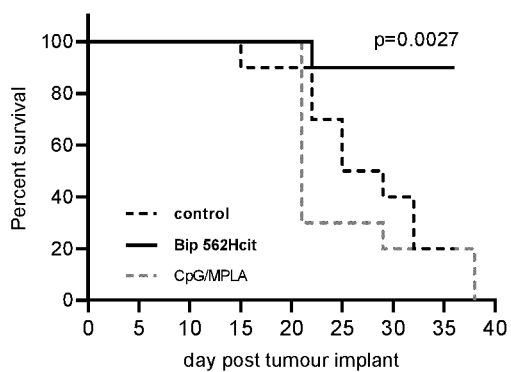
C
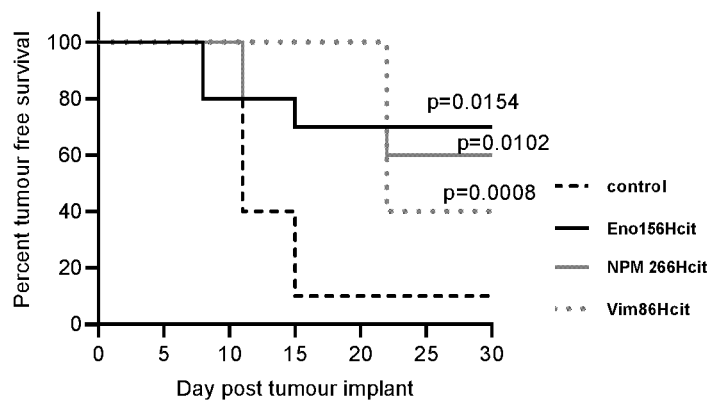

Figure 22
a
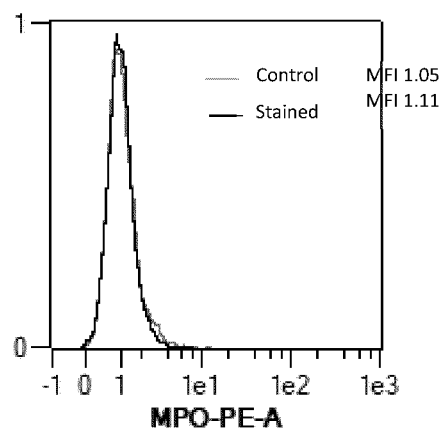
b
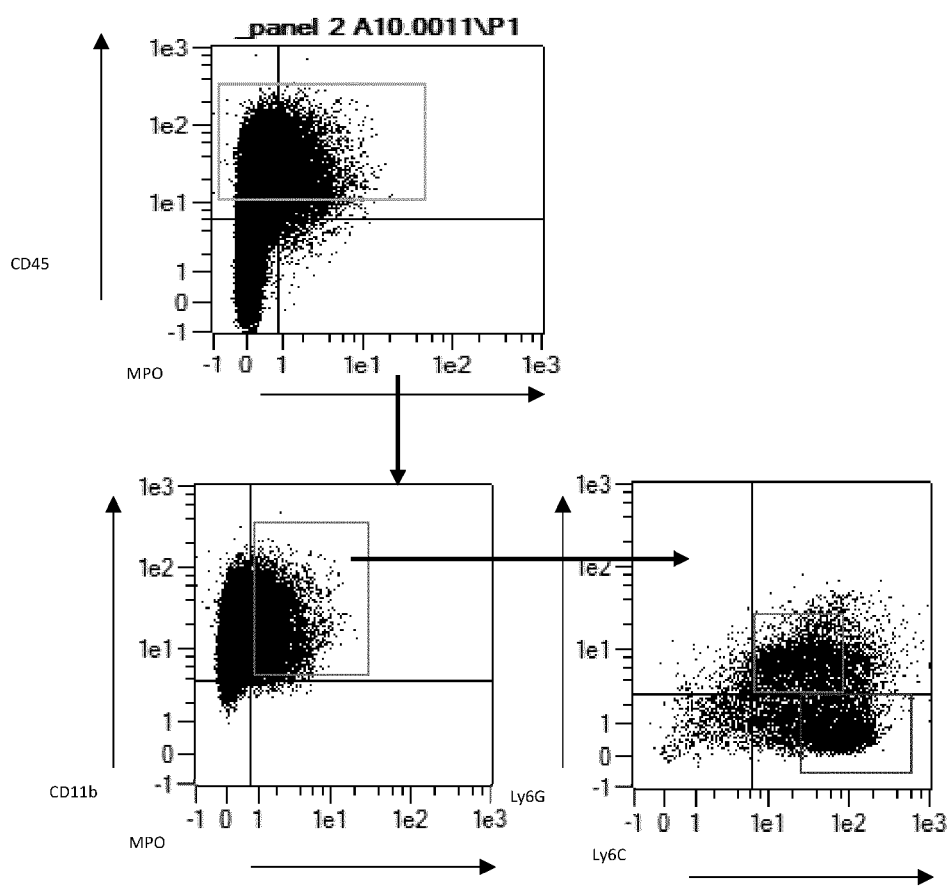

Figure 22 contd
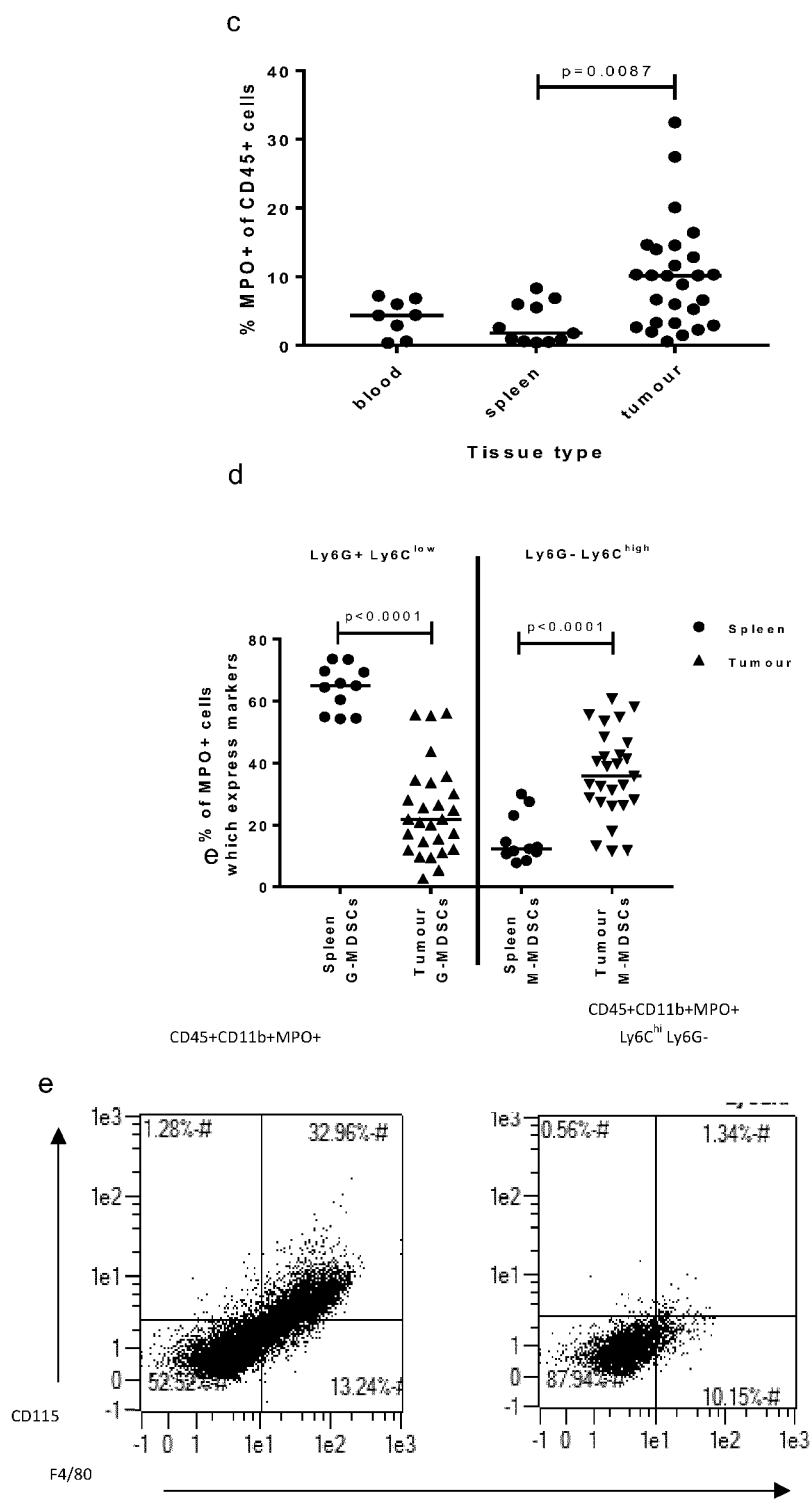

Figure 24
A
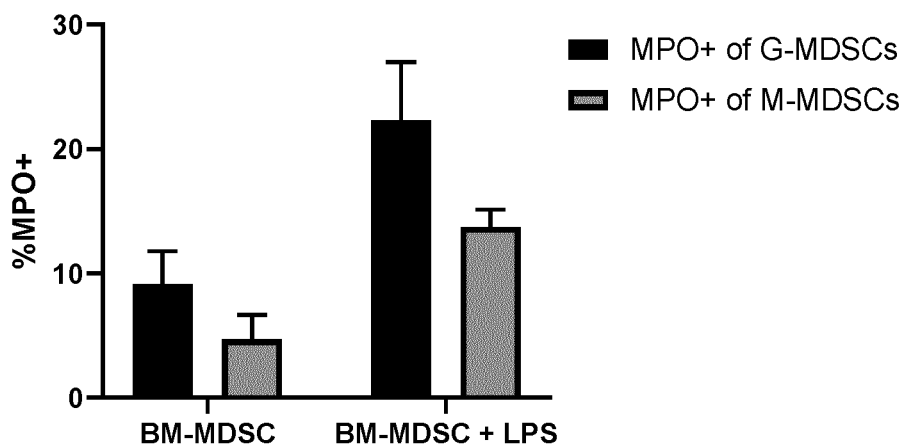
B
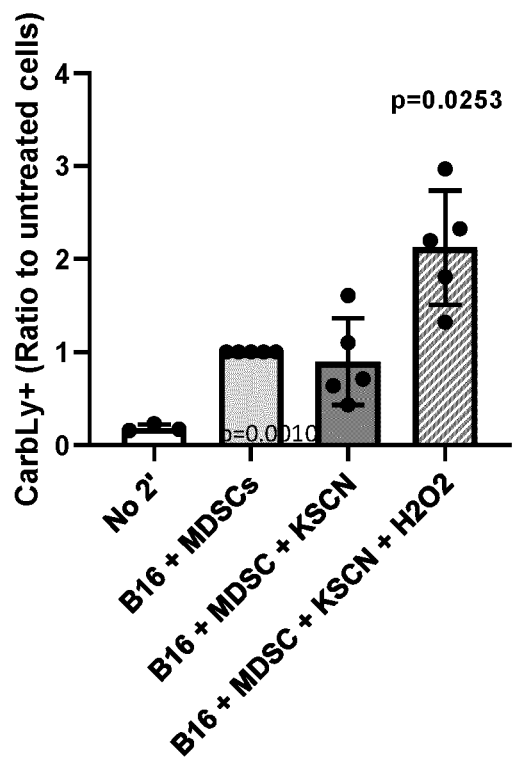

TREE MAP

A) TRA CFSE-High

Figure 27:
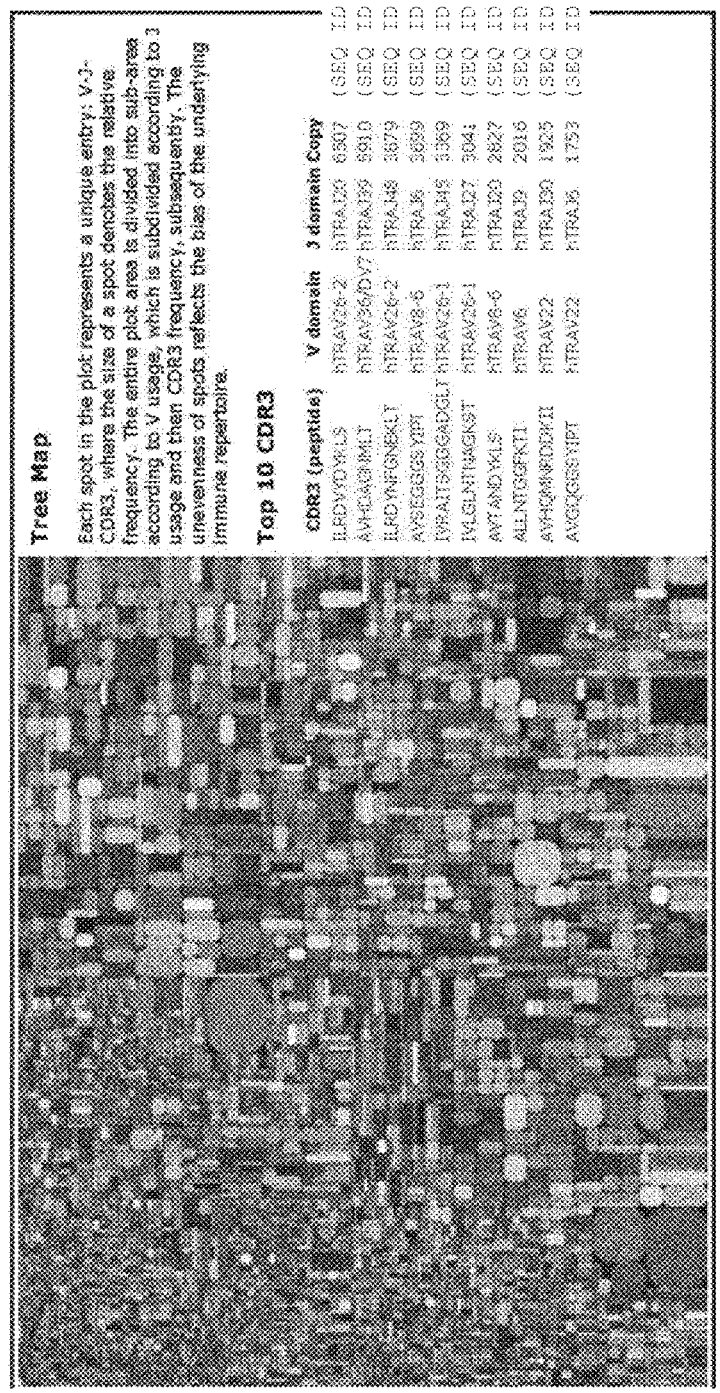
Figure 27:
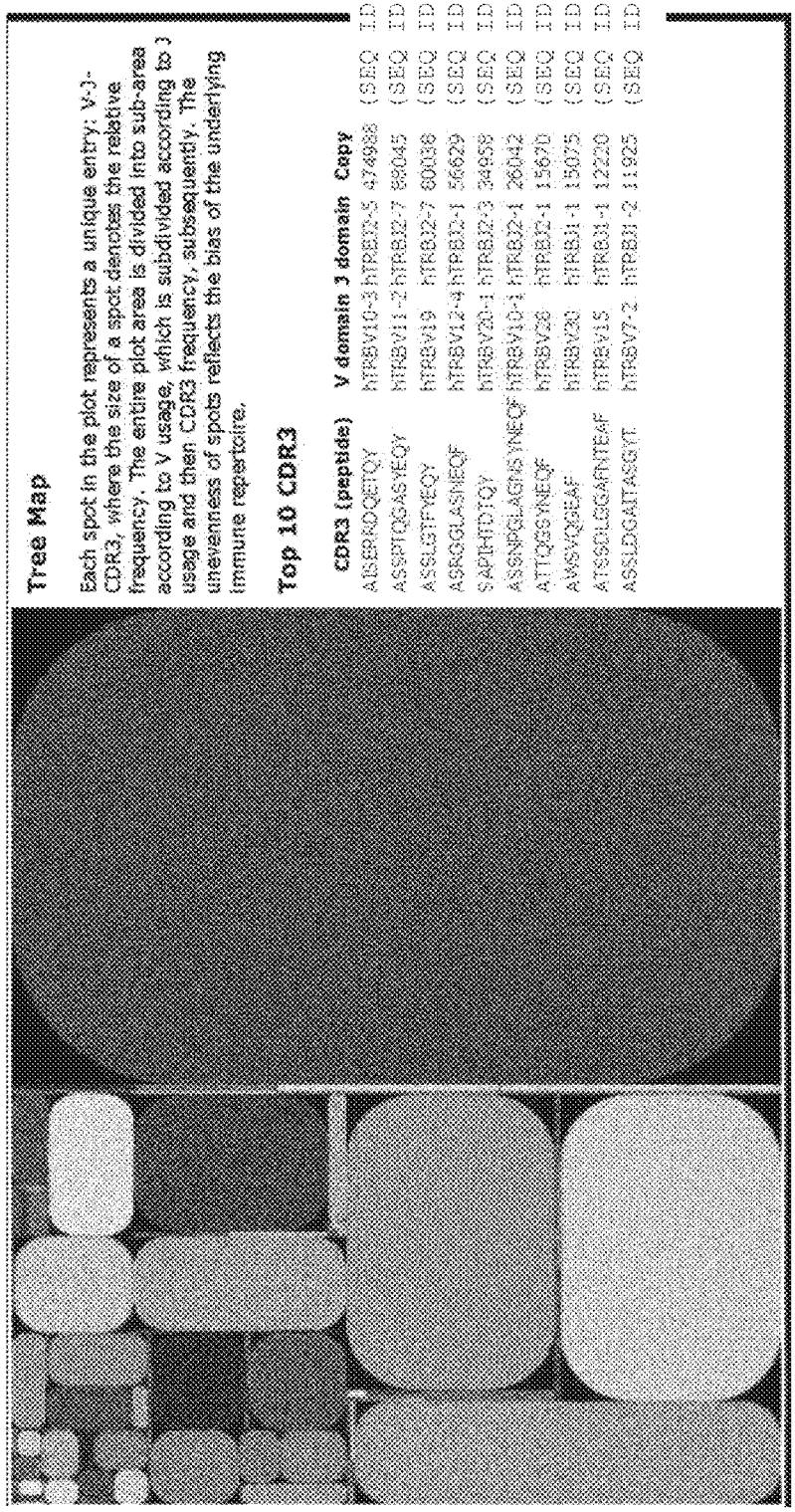

Figure 27 contd
B) TRA CFSE-Low
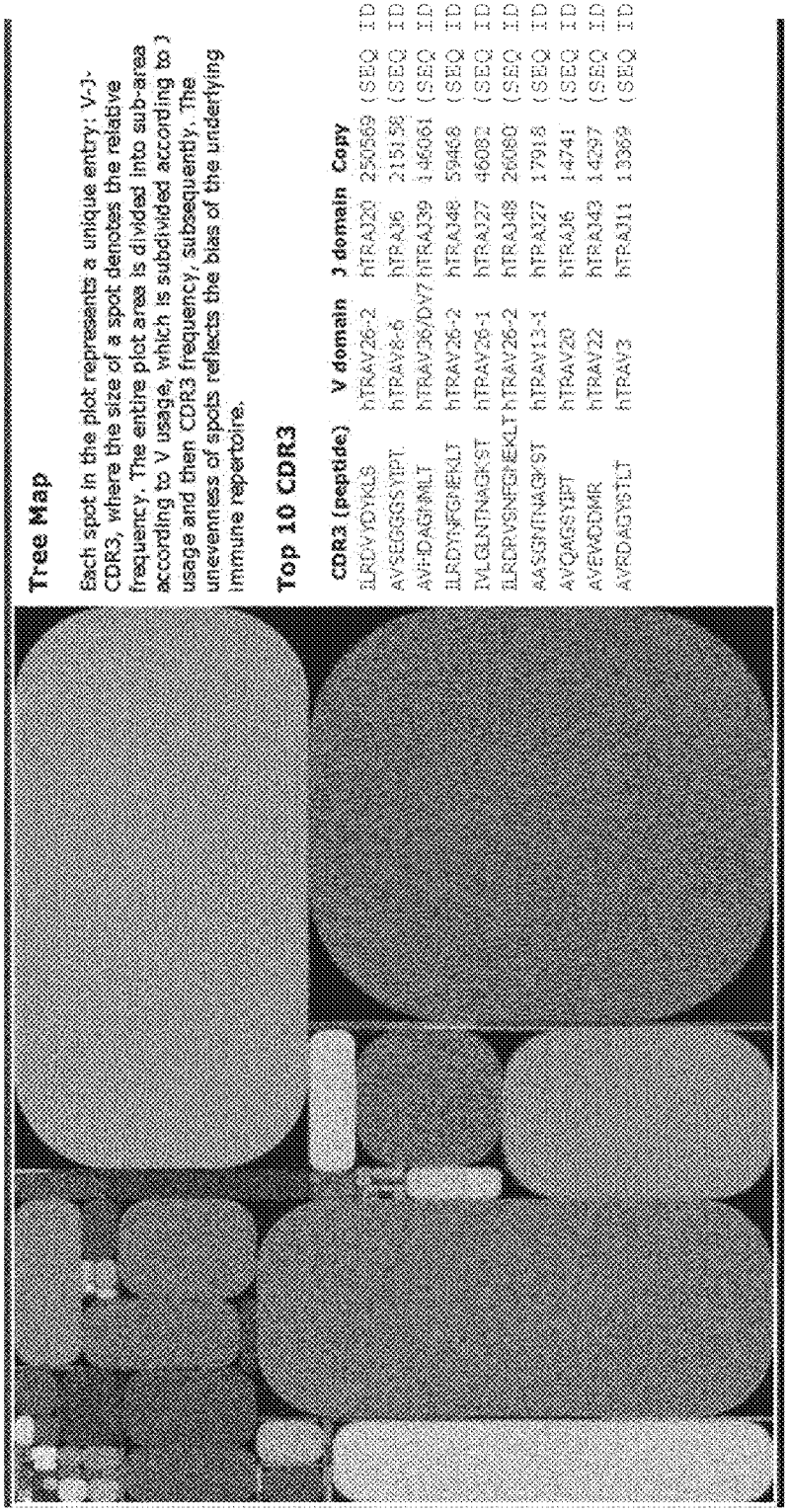

Figure 27 contd
A) TRB CFSE-High
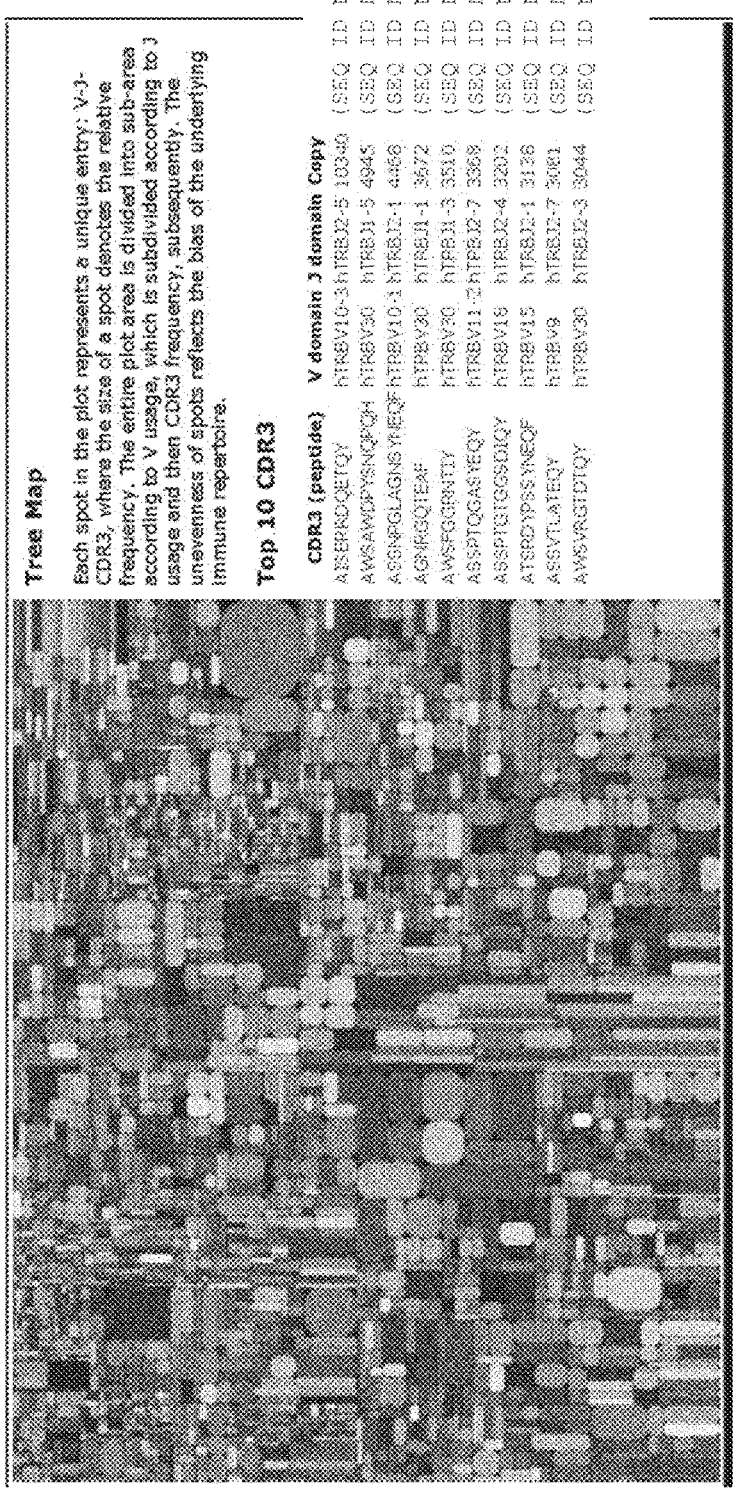

B) TRB CFSE-Low

Figure 28a SEQ3

TCR9: hTRBV10-3-CDR3(AISERRDQETQY). (SEQ ID NO: 87)

(SEQ ID NO: 1501)
GAT GCT GGA ATC ACC CAG AGC CCA AGA CAC AAG GTC ACA GAG ACA GGA ACA CCA
gtgactctgagatgtcatcagactgagaaccaccgctatatgtactggtatcgacaagacccggggcatgggctgag
gctgatccattactcatatGGTGTTAAAGATACTGACAAAGGAGAAGTCTCAGATGGCTATAGTGTCTCTAGATCAA
AGACAGAGGATTTCCTCCTCACTCTGGAGTCCGCTACCAGCTCCCAGACATCTGTGTACTTCTGTGCCATCAGTGAG
CGCCGGGACCaagagacccagtacttcgggccaggcacgcggctcctggtgctcgaggacctgaaaaacgtgttccc
acccgaggtcgctgtgtttgagccatcaga (SEQ ID NO: 1502)

```
1:  D   A   G   I   T   Q   S   P   R   H   K   V   T   E   T   G   T   P   V   T
    GATGCTGGAATCACCCAGAGCCCAAGACACAAGGTCACAGAGACAGGAACACCAGTGACT
1   ----------|----------|----------|----------|----------|----------|  60
    CTACGACCTTAGTGGGTCTCGGGTTCTGTGTTCCAGTGTCTCTGTCCTTGTGGTCACTGA

1:  L   R   C   H   Q   T   E   N   H   R   Y   M   Y   W   Y   R   Q   D   P   G
    CTGAGATGTCATCAGACTGAGAACCACCGCTATATGTACTGGTATCGACAAGACCCGGGG
61  ----------|----------|----------|----------|----------|----------|  120
    GACTCTACAGTAGTCTGACTCTTGGTGGCGATATACATGACCATAGCTGTTCTGGGCCCC

1:  H   G   L   R   L   I   H   Y   S   Y   G   V   K   D   T   D   K   G   E   V
    CATGGGCTGAGGCTGATCCATTACTCATATGGTGTTAAAGATACTGACAAGGAGAAGTC
121 ----------|----------|----------|----------|----------|----------|  180
    GTACCCGACTCCGACTAGGTAATGAGTATACCACAATTTCTATGACTGTTCCTCTTCAG

1:  S   D   G   Y   S   V   S   R   S   K   T   E   D   F   L   L   T   L   E   S
    TCAGATGGCTATAGTGTCTCTAGATCAAAGACAGAGGATTTCCTCCTCACTCTGGAGTCC
181 ----------|----------|----------|----------|----------|----------|  240
    AGTCTACCGATATCACAGAGATCTAGTTTCTGTCTCCTAAAGGAGGAGTGAGACCTCAGG

1:  A   T   S   S   Q   T   S   V   Y   F   C   A   I   S   E   R   R   D   Q   E
    GCTACCAGCTCCCAGACATCTGTGTACTTCTGTGCCATCAGTGAGCGCCGGGACCAAGAG
241 ----------|----------|----------|----------|----------|----------|  300
    CGATGGTCGAGGGTCTGTAGACACATGAAGACACGGTAGTCACTCGCGGCCCTGGTTCTC

1:  T   Q   Y   F   G   P   G   T   R   L   L   V   L   E   D   L   K   N   V   F
    ACCCAGTACTTCGGGCCAGGCACGCGGCTCCTGGTGCTCGAGGACCTGAAAAACGTGTTC
301 ----------|----------|----------|----------|----------|----------|  360
    TGGGTCATGAAGCCCGGTCCGTGCGCCGAGGACCACGAGCTCCTGGACTTTTTGCACAAG

1:  P   P   E   V   A   V   F   E   P   S   (SEQ ID NO: 683)
    CCACCCGAGGTCGCTGTGTTTGAGCCATCAGA (SEQ ID NO: 682)
361 ----------|----------|----------|---  392
    GGTGGGCTCCAGCGACACAAACTCGGTAGTCT (SEQ ID NO: 1503)
```

Figure 28b SEQ4

TCR9: hTRAV26-2-CDR3 (ILRDVYDYKLS) (SEQ ID NO: 90)

(SEQ ID NO: 1504)
GAT GCT AAG ACC ACA CAG  CCA AAT TCA ATG GAG AGT AAC GAA GAA GAG CCT
gttcacttgccttgtaaccactccacaatcagtggaactgattacatacattggtatcgacagcttccctcccaggg
tccAGAGTACGTGATTCATGGTCTTACAAGCAATGTGAACAACAGAATGGCCTCTCTGGCAATCGCTGAAGACAGAA
AGTCCAGTACCTTGATCCTGCACCGTGCTACCTTGAGAGATGCTGCTGTGTACTACTGCATCCTGAGAGACGTTTAC
GACTACAAGCtcagctttggagccggaaccacagtaactgtaagagcaaatatccagaaccctgaccctgccgtgta
ccagctgagagact (SEQ ID NO: 1505)

```
  1: D   A   K   T   T   Q   P   N   S   M   E   S   N   E   E   E   P   V   H   L
     GATGCTAAGACCACACAGCCAAATTCAATGGAGAGTAACGAAGAAGAGCCTGTTCACTTG
  1  ----------|----------|----------|----------|----------|----------|  60
     CTACGATTCTGGTGTGTCGGTTTAAGTTACCTCTCATTGCTTCTTCTCGGACAAGTGAAC

1: P   C   N   H   S   T   I   S   G   T   D   Y   I   H   W   Y   R   Q   L   P
     CCTTGTAACCACTCCACAATCAGTGGAACTGATTACATACATTGGTATCGACAGCTTCCC
 61  ----------|----------|----------|----------|----------|----------|  120
     GGAACATTGGTGAGGTGTTAGTCACCTTGACTAATGTATGTAACCATAGCTGTCGAAGGG

1: S   Q   G   P   E   Y   V   I   H   G   L   T   S   N   V   N   N   R   M   A
     TCCCAGGGTCCAGAGTACGTGATTCATGGTCTTACAAGCAATGTGAACAACAGAATGGCC
121  ----------|----------|----------|----------|----------|----------|  180
     AGGGTCCCAGGTCTCATGCACTAAGTACCAGAATGTTCGTTACACTTGTTGTCTTACCGG

1: S   L   A   I   A   E   D   R   K   S   S   T   L   I   L   H   R   A   T   L
     TCTCTGGCAATCGCTGAAGACAGAAAGTCCAGTACCTTGATCCTGCACCGTGCTACCTTG
181  ----------|----------|----------|----------|----------|----------|  240
     AGAGACCGTTAGCGACTTCTGTCTTTCAGGTCATGGAACTAGGACGTGGCACGATGGAAC

1: R   D   A   A   V   Y   Y   C   I   L   R   D   V   Y   D   Y   K   L   S   F
     AGAGATGCTGCTGTGTACTACTGCATCCTGAGAGACGTTTACGACTACAAGCTCAGCTTT
241  ----------|----------|----------|----------|----------|----------|  300
     TCTCTACGACGACACATGATGACGTAGGACTCTCTGCAAATGCTGATGTTCGAGTCGAAA

1: G   A   G   T   T   V   T   V   R   A   N   I   Q   N   P   D   P   A   V   Y
     GGAGCCGGAACCACAGTAACTGTAAGAGCAAATATCCAGAACCCTGACCCTGCCGTGTAC
301  ----------|----------|----------|----------|----------|----------|  360
     CCTCGGCCTTGGTGTCATTGACATTCTCGTTTATAGGTCTTGGGACTGGGACGGCACATG

1: Q   L   R   D   (SEQ ID NO: 685)
     CAGCTGAGAGACT (SEQ ID NO: 684)
361  ----------|---  373
     GTCGACTCTCTGA (SEQ ID NO: 1506)
```

Figure 29a SEQ15

TCR 10: hTRBV20-1-CDR3 (SAPIHTDTQY). (SEQ ID NO: 93)

(SEQ ID NO: 1507)
GGT GCT GTC GTC TCT CAA CAT CCG AGC TGG GTT ATC TGT AAG AGT GGA ACC TCT
gtgaagatcgagtgccgttccctggactttcaggccacaactatgttttggtatcgtcagttcccgaaacagagtct
catgctgatggcaacttccaatGAGGGCTCCAAGGCCACATACGAGCAAGGCGTCGAGAAGGACAAGTTTCTCATCA
ACCATGCAAGCCTGACCTTGTCCACTCTGACAGTGACCAGTGCCCATCCTGAAGACAGCAGCTTCTACATCTGCAGT
GCCCCAATAcatacagatacgcagtattttggcccaggcaccggctgacagtgctcgaggacctgaaaaacgtgtt
cccacccgaggtcgctgtgtttgagccatcaga (SEQ ID NO: 1508)

```
  1: G  A  V  V  S  Q  H  P  S  W  V  I  C  K  S  G  T  S  V  K
     GGTGCTGTCGTCTCTCAACATCCGAGCTGGGTTATCTGTAAGAGTGGAACCTCTGTGAAG
  1  ----------|----------|----------|----------|----------|----------| 60
     CCACGACAGCAGAGAGTTGTAGGCTCGACCCAATAGACATTCTCACCTTGGAGACACTTC

1: I  E  C  R  S  L  D  F  Q  A  T  T  M  F  W  Y  R  Q  F  P
     ATCGAGTGCCGTTCCCTGGACTTTCAGGCCACAACTATGTTTTGGTATCGTCAGTTCCCG
 61  ----------|----------|----------|----------|----------|----------| 120
     TAGCTCACGGCAAGGGACCTGAAAGTCCGGTGTTGATACAAAACCATAGCAGTCAAGGGC

1: K  Q  S  L  M  L  M  A  T  S  N  E  G  S  K  A  T  Y  E  Q
     AAACAGAGTCTCATGCTGATGGCAACTTCCAATGAGGGCTCCAAGGCCACATACGAGCAA
121  ----------|----------|----------|----------|----------|----------| 180
     TTTGTCTCAGAGTACGACTACCGTTGAAGGTTACTCCCGAGGTTCCGGTGTATGCTCGTT

1: G  V  E  K  D  K  F  L  I  N  H  A  S  L  T  L  S  T  L  T
     GGCGTCGAGAAGGACAAGTTTCTCATCAACCATGCAAGCCTGACCTTGTCCACTCTGACA
181  ----------|----------|----------|----------|----------|----------| 240
     CCGCAGCTCTTCCTGTTCAAAGAGTAGTTGGTACGTTCGGACTGGAACAGGTGAGACTGT

1: V  T  S  A  H  P  E  D  S  S  F  Y  I  C  S  A  P  I  H  T
     GTGACCAGTGCCCATCCTGAAGACAGCAGCTTCTACATCTGCAGTGCCCCAATACATACA
241  ----------|----------|----------|----------|----------|----------| 300
     CACTGGTCACGGGTAGGACTTCTGTCGTCGAAGATGTAGACGTCACGGGGTTATGTATGT

1: D  T  Q  Y  F  G  P  G  T  R  L  T  V  L  E  D  L  K  N  V
     GATACGCAGTATTTTGGCCCAGGCACCGGCTGACAGTGCTCGAGGACCTGAAAAACGTG
301  ----------|----------|----------|----------|----------|----------| 360
     CTATGCGTCATAAAACCGGGTCCGTGGGCCGACTGTCACGAGCTCCTGGACTTTTTGCAC

1: F  P  P  E  V  A  V  F  E  P  S  (SEQ ID NO: 687)
     TTCCCACCCGAGGTCGCTGTGTTTGAGCCATCAGA (SEQ ID NO: 686)
361  ----------|----------|-----  395
     AAGGGTGGGCTCCAGCGACACAAACTCGGTAGTCT (SEQ ID NO: 1509)
```

Figure 29b SEQ16

TCR10 hTRAV36/DV7-CDR3 (AVHDAGNMLT) (SEQ ID NO: 96)

```
GAA GAC AAG GTG GTA CAA AGC CCT CTA TCT CTG GTT GTC(SEQ ID NO: 1510)
cacgagggagacactgtaactctcaattgcagttatgaagtgactaactttcgaagcctactatggtacaagcagga
aaagaaagctcccacATTTCTATTTATGCTAACTTCAAGTGGAATTGAAAAGAAGTCAGGAAGACTAAGTAGCATAT
TAGATAAGAAAGAACTTTTCAGCATCCTGAACATCACAGCCACCCAGACCGGAGACTCGGCCGTCTACCTCTGTGCT
GTGCACGATgcaggcaacatgctcacctttggagggggaacaaggttaatggtcaaaccccatatccagaaccctga
ccctgccgtgtaccagctgagagact(SEQ ID NO: 1511)
```

```
      1: E   D   K   V   V   Q   S   P   L   S   L   V   V   H   E   G   D   T   V   T
         GAAGACAAGGTGGTACAAAGCCCTCTATCTCTGGTTGTCCACGAGGGAGACACTGTAACT
      1 ----------|----------|----------|----------|----------|----------|   60
         CTTCTGTTCCACCATGTTTCGGAGATAGAGACCAACAGGTGCTCCCTCTGTGACATTGA

1: L   N   C   S   Y   E   V   T   N   F   R   S   L   L   W   Y   K   Q   E   K
         CTCAATTGCAGTTATGAAGTGACTAACTTTCGAAGCCTACTATGGTACAAGCAGGAAAAG
     61 ----------|----------|----------|----------|----------|----------|   120
         GAGTTAACGTCAATACTTCACTGATTGAAAGCTTCGGATGATACCATGTTCGTCCTTTTC

1: K   A   P   T   F   L   F   M   L   T   S   S   G   I   E   K   K   S   G   R
         AAAGCTCCCACATTTCTATTTATGCTAACTTCAAGTGGAATTGAAAAGAAGTCAGGAAGA
    121 ----------|----------|----------|----------|----------|----------|   180
         TTTCGAGGGTGTAAAGATAAATACGATTGAAGTTCACCTTAACTTTTCTTCAGTCCTTCT

1: L   S   S   I   L   D   K   K   E   L   F   S   I   L   N   I   T   A   T   Q
         CTAAGTAGCATATTAGATAAGAAAGAACTTTTCAGCATCCTGAACATCACAGCCACCCAG
    181 ----------|----------|----------|----------|----------|----------|   240
         GATTCATCGTATAATCTATTCTTTCTTGAAAAGTCGTAGGACTTGTAGTGTCGGTGGGTC

1: T   G   D   S   A   V   Y   L   C   A   V   H   D   A   G   N   M   L   T   F
         ACCGGAGACTCGGCCGTCTACCTCTGTGCTGTGCACGATGCAGGCAACATGCTCACCTTT
    241 ----------|----------|----------|----------|----------|----------|   300
         TGGCCTCTGAGCCGGCAGATGGAGACACGACACGTGCTACGTCCGTTGTACGAGTGGAAA

1: G   G   G   T   R   L   M   V   K   F   H   I   Q   N   P   D   P   A   V   Y
         GGAGGGGGAACAAGGTTAATGGTCAAACCCCATATCCAGAACCCTGACCCTGCCGTGTAC
    301 ----------|----------|----------|----------|----------|----------|   360
         CCTCCCCCTTGTTCCAATTACCAGTTTGGGGTATAGGTCTTGGGACTGGGACGGCACATG

1: Q   L   R   D (SEQ ID NO: 689)
         CAGCTGAGAGACT(SEQ ID NO: 688)
    361 ----------|--- 373
         GTCGACTCTCTGA(SEQ ID NO: 1512)
```

Figure 30a SEQ17

TCR11: hTRBV12-4-CDR3 (ASRGGLASNEQF)(SEQ ID NO: 99)

```
                                                                  (SEQ ID NO: 1513)
GAT GCT GGA GTT ATC CAG TCA CCC CGG CAC GAG GTG ACA GAG ATG GGA CAA GAA
gtgactctgagatgtaaaccaatttcaggacacgactacctttctggtacagacagaccatgatgcggggactgga
gttgctcatttactttaacaacAACGTTCCGATAGATGATTCAGGGATGCCCGAGGATCGATTCTCAGCTAAGATGC
CTAATGCATCATTCTCCACTCTGAAGATCCAGCCCTCAGAACCCAGGGACTCAGCTGTGTACTTCTGTGCCAGCAGG
GGGGGACTAGcctccaatgagcagttcttcgggccagggacacggctcaccgtgctagaggacctgaaaaacgtgtt
cccacccgaggtcgctgtgtttgagccatcaga(SEQ ID NO: 1514)
```

```
  1: D   A   G   V   I   Q   S   P   R   H   E   V   T   E   M   G   Q   E   V   T
     GATGCTGGAGTTATCCAGTCACCCCGGCACGAGGTGACAGAGATGGGACAAGAAGTGACT
  1  ----------!----------!----------!----------!----------!----------!  60
     CTACGACCTCAATAGGTCAGTGGGGCCGTGCTCCACTGTCTCTACCCTGTTCTTCACTGA

1: L   R   C   K   P   I   S   G   H   D   Y   L   F   W   Y   R   Q   T   M   M
     CTGAGATGTAAACCAATTTCAGGACACGACTACCTTTTCTGGTACAGACAGACCATGATG
 61  ----------!----------!----------!----------!----------!----------!  120
     GACTCTACATTTGGTTAAAGTCCTGTGCTGATGGAAAAGACCATGTCTGTCTGGTACTAC

1: R   G   L   E   L   L   I   Y   F   N   N   N   V   P   I   D   D   S   G   M
     CGGGGACTGGAGTTGCTCATTTACTTTAACAACAACGTTCCGATAGATGATTCAGGGATG
121  ----------!----------!----------!----------!----------!----------!  180
     GCCCCTGACCTCAACGAGTAAATGAAATTGTTGTTGCAAGGCTATCTACTAAGTCCCTAC

1: P   E   D   R   F   S   A   K   M   P   N   A   S   F   S   T   L   K   I   Q
     CCCGAGGATCGATTCTCAGCTAAGATGCCTAATGCATCATTCTCCACTCTGAAGATCCAG
181  ----------!----------!----------!----------!----------!----------!  240
     GGGCTCCTAGCTAAGAGTCGATTCTACGGATTACGTAGTAAGAGGTGAGACTTCTAGGTC

1: F   S   E   P   R   D   S   A   V   Y   F   C   A   S   R   G   G   L   A   S
     CCCTCAGAACCCAGGGACTCAGCTGTGTACTTCTGTGCCAGCAGGGGGGGACTAGCCTCC
241  ----------!----------!----------!----------!----------!----------!  300
     GGGAGTCTTGGGTCCCTGAGTCGACACATGAAGACACGGTCGTCCCCCCTGATCGGAGG

1: N   E   Q   F   F   G   P   G   T   R   L   T   V   L   E   D   L   K   N   V
     AATGAGCAGTTCTTCGGGCCAGGGACACGGCTCACCGTGCTAGAGGACCTGAAAAACGTG
301  ----------!----------!----------!----------!----------!----------!  360
     TTACTCGTCAAGAAGCCCGGTCCCTGTGCCGAGTGGCACGATCTCCTGGACTTTTTGCAC

1: F   P   P   E   V   A   V   F   E   P   S (SEQ ID NO: 691)
     TTCCCACCCGAGGTCGCTGTGTTTGAGCCATCAGA (SEQ ID NO: 690)
361  ----------!----------!----------!----- 395
     AAGGGTGGGCTCCAGCGACACAAACTCGGTAGTCT (SEQ ID NO: 1515)
```

Figure 30b SEQ18

TCR11: hTRAV8-6-CDR3 (AVSEGGGSYIPT) (SEQ ID NO: 102)

```
                                                             (SEQ ID NO: 1516)
GCC CAG TCT GTG ACC CAG CTT GAC AGC CAA GTC CCT GTC TTT GAA GAA GCC
cctgtggagctgaggtgcaactactcatcgtctgtttcagtgtatctcttctggtatgtgcaataccccaaccaagg
actccagcttctcctGAAGTATTTATCAGGATCCACCCTGGTTAAAGGCATCAACGGTTTTGAGGCTGAATTTAACA
AGAGTCAAACTTCCTTCCACTTGAGGAAACCCTCAGTCCATATAAGCGACACGGCTGAGTACTTCTGTGCTgtgagt
gaaggcggaggaagctacatacctacatttggaagaggaaccagccttattgttcatccgtatatccagaaccctga
ccctgccgtgtaccagctgagagact (SEQ ID NO: 1517)
```

```
  1: A  Q  S  V  T  Q  L  D  S  Q  V  P  V  F  E  E  A  P  V  E
     GCCCAGTCTGTGACCCAGCTTGACAGCCAAGTCCCTGTCTTTGAAGAAGCCCCTGTGGAG
   1 ----------|----------|----------|----------|----------|----------| 60
     CGGGTCAGACACTGGGTCGAACTGTCGGTTCAGGGACAGAAACTTCTTCGGGGACACCTC

1: L  R  C  N  Y  S  S  S  V  S  V  Y  L  F  W  Y  V  Q  Y  P
     CTGAGGTGCAACTACTCATCGTCTGTTTCAGTGTATCTCTTCTGGTATGTGCAATACCCC
  61 ----------|----------|----------|----------|----------|----------| 120
     GACTCCACGTTGATGAGTAGCAGACAAAGTCACATAGAGAAGACCATACACGTTATGGGG

1: N  Q  G  L  Q  L  L  L  K  Y  L  S  G  S  T  L  V  K  G  I
     AACCAAGGACTCCAGCTTCTCCTGAAGTATTTATCAGGATCCACCCTGGTTAAAGGCATC
 121 ----------|----------|----------|----------|----------|----------| 180
     TTGGTTCCTGAGGTCGAAGAGGACTTCATAAATAGTCCTAGGTGGGACCAATTTCCGTAG

1: N  G  F  E  A  E  F  N  K  S  Q  T  S  F  H  L  R  K  P  S
     AACGGTTTTGAGGCTGAATTTAACAAGAGTCAAACTTCCTTCCACTTGAGGAAACCCTCA
 181 ----------|----------|----------|----------|----------|----------| 240
     TTGCCAAAACTCCGACTTAAATTGTTCTCAGTTTGAAGGAAGGTGAACTCCTTTGGGAGT

1: V  H  I  S  D  T  A  E  Y  F  C  A  V  S  E  G  G  G  S  Y
     GTCCATATAAGCGACACGGCTGAGTACTTCTGTGCTGTGAGTGAAGGCGGAGGAAGCTAC
 241 ----------|----------|----------|----------|----------|----------| 300
     CAGGTATATTCGCTGTGCCGACTCATGAAGACACGACACTCACTTCCGCCTCCTTCGATG

1: I  P  T  F  G  R  G  T  S  L  I  V  H  P  Y  I  Q  N  P  D
     ATACCTACATTTGGAAGAGGAACCAGCCTTATTGTTCATCCGTATATCCAGAACCCTGAC
 301 ----------|----------|----------|----------|----------|----------| 360
     TATGGATGTAAACCTTCTCCTTGGTCGGAATAACAAGTAGGCATATAGGTCTTGGGACTG

1: P  A  V  Y  Q  L  R  D (SEQ ID NO: 693)
     CCTGCCGTGTACCAGCTGAGAGACT (SEQ ID NO: 692)
 361 ----------|----------|------ 385
     GGACGGCACATGGTCGACTCTCTGA (SEQ ID NO: 1518)
```

Figure 31a SEQ19

TCR 12 hTRBV19-CDR3 (ASSLGTFYEQY) (SEQ ID NO: 105)

(SEQ ID NO: 1519)
GAT GGT GGA ATC ACT CAG TCC CCA AAG TAC CTG TTC AGA AAG GAA GGA CAG AAT
gtgaccctgagttgtgaacagaatttgaaccacgatgccatgtactggtaccgacaggacccaggggcaagggctgag
attgatctactactcacAGATAGTAAATGACTTTCAGAAAGGAGATATAGCTGAAGGGTACAGCGTCTCTCGGGAGA
AGAAGGAATCCTTTCCTCTCACTGTGACATCGGCCCAAAAGAACCCGACAGCTTTCTATCTCTGTGCCAGTAGTCTC
GGGACATTctacgagcagtacttcgggccgggcaccaggctcacggtcacagaggacctgaaaaacgtgttcccacc
cgaggtcgctgtgtttgagccatcaga (SEQ ID NO: 1520)

```
     1: D   G   G   I   T   Q   S   P   K   Y   L   F   R   K   E   G   Q   N   V   T
        GATGGTGGAATCACTCAGTCCCCAAAGTACCTGTTCAGAAAGGAAGGACAGAATGTGACC
     1  ----------!----------!----------!----------!----------!----------!  60
        CTACCACCTTAGTGAGTCAGGGGTTTCATGGACAAGTCTTTCCTTCCTGTCTTACACTGG

1: L   S   C   E   Q   N   L   N   H   D   A   M   Y   W   Y   R   Q   D   P   G
        CTGAGTTGTGAACAGAATTTGAACCACGATGCCATGTACTGGTACCGACAGGACCCAGGG
    61  ----------!----------!----------!----------!----------!----------!  120
        GACTCAACACTTGTCTTAAACTTGGTGCTACGGTACATGACCATGGCTGTCCTGGGTCCC

1: Q   G   L   R   L   I   Y   Y   S   Q   I   V   N   D   F   Q   K   G   D   I
        CAAGGGCTGAGATTGATCTACTACTCACAGATAGTAAATGACTTTCAGAAAGGAGATATA
   121  ----------!----------!----------!----------!----------!----------!  180
        GTTCCCGACTCTAACTAGATGATGAGTGTCTATCATTTACTGAAAGTCTTTCCTCTATAT

1: A   E   G   Y   S   V   S   R   E   K   K   E   S   F   P   L   T   V   T   S
        GCTGAAGGGTACAGCGTCTCTCGGGAGAAGAAGGAATCCTTTCCTCTCACTGTGACATCG
   181  ----------!----------!----------!----------!----------!----------!  240
        CGACTTCCCATGTCGCAGAGAGCCCTCTTCTTCCTTAGGAAAGGAGAGTGACACTGTAGC

1: A   Q   K   N   P   T   A   F   Y   L   C   A   S   S   L   G   T   F   Y   E
        GCCCAAAAGAACCCGACAGCTTTCTATCTCTGTGCCAGTAGTCTCGGGACATTCTACGAG
   241  ----------!----------!----------!----------!----------!----------!  300
        CGGGTTTTCTTGGGCTGTCGAAAGATAGAGACACGGTCATCAGAGCCCTGTAAGATGCTC

1: Q   Y   F   G   P   G   T   R   L   T   V   T   E   D   L   K   N   V   F   P
        CAGTACTTCGGGCCGGGCACCAGGCTCACGGTCACAGAGGACCTGAAAAACGTGTTCCCA
   301  ----------!----------!----------!----------!----------!----------!  360
        GTCATGAAGCCCGGCCCGTGGTCCGAGTGCCAGTGTCTCCTGGACTTTTTGCACAAGGGT

1: P   E   V   A   V   F   E   P   S (SEQ ID NO: 695)
        CCCGAGGTCGCTGTGTTTGAGCCATCAGA (SEQ ID NO: 694)
   361  ----------!----------!---------  389
        GGGCTCCAGCGACACAAACTCGGTAGTCT (SEQ ID NO: 1521)
```

Figure 31b SEQ20

TCR12: hTRAV13-1-CDR3 (AASGNTNAGKST) (SEQ ID NO: 108)

(SEQ ID NO: 1522)
GGA GAG AAT GTG GAG CAG CAT CCT TCA ACC CTG AGT GTC CAG GAG GGA GAC AGC
gctgttatcaagtgtacttattcagacagtgcctcaaactacttcccttggtataagcaagaacttggaaaaggacc
tcagcttatTATAGACATTCGTTCAAATGTGGGCGAAAAGAAAGACCAACGAATTGCTGTTACATTGAACAAGACAG
CCAAACATTTCTCCCTGCACATCACAGAGACCCAACCTGAAGACTCGGCTGTCTACTTCTGTGCAGCAAGTGGTAAC
ACCAATGCAggcaaatcaacctttggggatgggactacgctcactgtgaagccaaatatccagaaccctgaccctgc
cgtgtaccagctgagagact (SEQ ID NO: 1523)

```
  1: G  E  N  V  E  Q  H  P  S  T  L  S  V  Q  E  G  D  S  A  V
     GGAGAGAATGTGGAGCAGCATCCTTCAACCCTGAGTGTCCAGGAGGGAGACAGCGCTGTT
  1  ----------|----------|----------|----------|----------|----------| 60
     CCTCTCTTACACCTCGTCGTAGGAAGTTGGGACTCACAGGTCCTCCCTCTGTCGCGACAA

1: I  K  C  T  Y  S  D  S  A  S  N  Y  F  P  W  Y  K  Q  E  L
     ATCAAGTGTACTTATTCAGACAGTGCCTCAAACTACTTCCCTTGGTATAAGCAAGAACTT
 61  ----------|----------|----------|----------|----------|----------| 120
     TAGTTCACATGAATAAGTCTGTCACGGAGTTTGATGAAGGGAACCATATTCGTTCTTGAA

1: G  K  G  P  Q  L  I  I  D  I  R  S  N  V  G  E  K  K  D  Q
     GGAAAAGGACCTCAGCTTATTATAGACATTCGTTCAAATGTGGGCGAAAAGAAAGACCAA
121  ----------|----------|----------|----------|----------|----------| 180
     CCTTTTCCTGGAGTCGAATAATATCTGTAAGCAAGTTTACACCCGCTTTTCTTTCTGGTT

1: R  I  A  V  T  L  N  K  T  A  K  H  F  S  L  H  I  T  E  T
     CGAATTGCTGTTACATTGAACAAGACAGCCAAACATTTCTCCCTGCACATCACAGAGACC
181  ----------|----------|----------|----------|----------|----------| 240
     GCTTAACGACAATGTAACTTGTTCTGTCGGTTTGTAAAGAGGGACGTGTAGTGTCTCTGG

1: Q  P  E  D  S  A  V  Y  F  C  A  A  S  G  N  T  N  A  G  K
     CAACCTGAAGACTCGGCTGTCTACTTCTGTGCAGCAAGTGGTAACACCAATGCAGGCAAA
241  ----------|----------|----------|----------|----------|----------| 300
     GTTGGACTTCTGAGCCGACAGATGAAGACACGTCGTTCACCATTGTGGTTACGTCCGTTT

1: S  T  F  G  D  G  T  T  L  T  V  K  P  N  I  Q  N  P  D  P
     TCAACCTTTGGGGATGGGACTACGCTCACTGTGAAGCCAAATATCCAGAACCCTGACCCT
301  ----------|----------|----------|----------|----------|----------| 360
     AGTTGGAAACCCCTACCCTGATGCGAGTGACACTTCGGTTTATAGGTCTTGGGACTGGGA

1: A  V  Y  Q  L  R  D (SEQ ID NO: 697)
     GCCGTGTACCAGCTGAGAGACT (SEQ ID NO: 696)
361  ----------|----------|-- 382
     CGGCACATGGTCGACTCTCTGA (SEQ ID NO: 1524)
```

Figure 32a SEQ21

TCR13 hTRBV5-1-CDR3 (ASSLGVMVVSTDTQY) (SEQ ID NO: 111)

AAG GCT GGA GTC ACT CAA ACT CCA AGA TAT CTG ATC AAA ACG AGA (SEQ ID NO: 1525)
ggacagcaagtgacactgagctgctcccctatctctgggcataggagtgtatcctggtaccaacagaccccaggaca
gggccttcagttcctctttgaatacttcagtgagacaCAGAGAAACAAAGGAAACTTCCCTGGTCGATTCTCAGGGC
GCCAGTTCTCTAACTCTCGCTCTGAGATGAATGTGAGCACCTTGGAGCTGGGGGACTCGGCCCTTTATCTTTGCGCC
AGCAGCTTAGGtgttatggtcgttagtacagatacgcagtattttggcccaggcacccggctgacagtgctcgagga
cctgaaaaacgtgttcccacccgaggtcgctgtgtttgagccatcaga (SEQ ID NO: 1526)

```
    1: K   A   G   V   T   Q   T   P   R   Y   L   I   K   T   R   G   Q   Q   V   T
       AAGGCTGGAGTCACTCAAACTCCAAGATATCTGATCAAAACGAGAGGACAGCAAGTGACA
    1  ----------|----------|----------|----------|----------|----------|  60
       TTCCGACCTCAGTGAGTTTGAGGTTCTATAGACTAGTTTTGCTCTCCTGTCGTTCACTGT

1: L   S   C   S   P   I   S   G   H   R   S   V   S   W   Y   Q   Q   T   P   G
       CTGAGCTGCTCCCCTATCTCTGGGCATAGGAGTGTATCCTGGTACCAACAGACCCCAGGA
   61  ----------|----------|----------|----------|----------|----------|  120
       GACTCGACGAGGGGATAGAGACCCGTATCCTCACATAGGACCATGGTTGTCTGGGGTCCT

1: Q   G   L   Q   F   L   F   E   Y   F   S   E   T   Q   R   N   K   G   N   F
       CAGGGCCTTCAGTTCCTCTTTGAATACTTCAGTGAGACACAGAGAAACAAAGGAAACTTC
  121  ----------|----------|----------|----------|----------|----------|  180
       GTCCCGGAAGTCAAGGAGAAACTTATGAAGTCACTCTGTGTCTCTTTGTTTCCTTTGAAG

1: P   G   R   F   S   G   R   Q   F   S   N   S   R   S   E   M   N   V   S   T
       CCTGGTCGATTCTCAGGGCGCCAGTTCTCTAACTCTCGCTCTGAGATGAATGTGAGCACC
  181  ----------|----------|----------|----------|----------|----------|  240
       GGACCAGCTAAGAGTCCCGCGGTCAAGAGATTGAGAGCGAGACTCTACTTACACTCGTGG

1: L   E   L   G   D   S   A   L   Y   L   C   A   S   S   L   G   V   M   V   V
       TTGGAGCTGGGGGACTCGGCCCTTTATCTTTGCGCCAGCAGCTTAGGTGTTATGGTCGTT
  241  ----------|----------|----------|----------|----------|----------|  300
       AACCTCGACCCCCTGAGCCGGGAAATAGAAACGCGGTCGTCGAATCCACAATACCAGCAA

1: S   T   D   T   Q   Y   F   G   P   G   T   R   L   T   V   E   D   L   K
       AGTACAGATACGCAGTATTTTGGCCCAGGCACCCGGCTGACAGTGCTCGAGGACCTGAAA
  301  ----------|----------|----------|----------|----------|----------|  360
       TCATGTCTATGCGTCATAAAACCGGGTCCGTGGGCCGACTGTCACGAGCTCCTGGACTTT

1: N   V   F   P   P   E   V   A   V   F   E   P   S (SEQ ID NO: 699)
       AACGTGTTCCCACCCGAGGTCGCTGTGTTTGAGCCATCAGA (SEQ ID NO: 698)
  361  ----------|----------|----------|----------|- 401
       TTGCACAAGGGTGGGCTCCAGCGACACAAACTCGGTAGTCT (SEQ ID NO: 1527)
```

Figure 32b. SEQ22

```
TCR 13 hTRAV26-2-CDR3 (ILRDRVSNFGNEKLT)(SEQ ID NO: 112)
                                                          (SEQ ID NO: 1504)
GAT GCT AAG ACC ACA CAG CCA AAT TCA ATG GAG AGT AAC GAA GAA GAG CCT
gttcacttgccttgtaaccactccacaatcagtggaactgattacatacattggtatcgacagcttccctcccaggg
tccagagtacgtgatTCATGGTCTTACAAGCAATGTGAACAACAGAATGGCCTCTCTGGCAATCGCTGAAGACAGAA
AGTCCAGTACCTTGATCCTGCACCGTGCTACCTTGAGAGATGCTGCTGTGTACTACTGCATCCTGAGAGACAGGGTC
TCTAACTTTggaaatgagaaattaacctttgggactggaacaagactcaccatcatacccaatatccagaaccctga
ccctgccgtgtaccagctgagagact(SEQ ID NO: 1528)
```

```
1: D  A  K  T  T  Q  P  N  S  M  E  S  N  E  E  E  P  V  H  L
      GATGCTAAGACCACACAGCCAAATTCAATGGAGAGTAACGAAGAAGAGCCTGTTCACTTG
  1   ----------|----------|----------|----------|----------|----------|  60
      CTACGATTCTGGTGTGTCGGTTTAAGTTACCTCTCATTGCTTCTTCTCGGACAAGTGAAC

1: P  C  N  H  S  T  I  S  G  T  D  Y  I  H  W  Y  R  Q  L  P
      CCTTGTAACCACTCCACAATCAGTGGAACTGATTACATACATTGGTATCGACAGCTTCCC
 61   ----------|----------|----------|----------|----------|----------|  120
      GGAACATTGGTGAGGTGTTAGTCACCTTGACTAATGTATGTAACCATAGCTGTCGAAGGG

1: S  Q  G  P  E  Y  V  I  H  G  L  T  S  N  V  N  N  R  M  A
      TCCCAGGGTCCAGAGTACGTGATTCATGGTCTTACAAGCAATGTGAACAACAGAATGGCC
121   ----------|----------|----------|----------|----------|----------|  180
      AGGGTCCCAGGTCTCATGCACTAAGTACCAGAATGTTCGTTACACTTGTTGTCTTACCGG

1: S  L  A  I  A  E  D  R  K  S  S  T  L  I  L  H  R  A  T  L
      TCTCTGGCAATCGCTGAAGACAGAAAGTCCAGTACCTTGATCCTGCACCGTGCTACCTTG
181   ----------|----------|----------|----------|----------|----------|  240
      AGAGACCGTTAGCGACTTCTGTCTTTCAGGTCATGGAACTAGGACGTGGCACGATGGAAC

1: R  D  A  A  V  Y  Y  C  I  L  R  D  R  V  S  N  F  G  N  E
      AGAGATGCTGCTGTGTACTACTGCATCCTGAGAGACAGGGTCTCTAACTTTGGAAATGAG
241   ----------|----------|----------|----------|----------|----------|  300
      TCTCTACGACGACACATGATGACGTAGGACTCTCTGTCCCAGAGATTGAAACCTTTACTC

1: K  L  T  F  G  T  G  T  R  L  T  I  I  P  N  I  Q  N  P  D
      AAATTAACCTTTGGGACTGGAACAAGACTCACCATCATACCCAATATCCAGAACCCTGAC
301   ----------|----------|----------|----------|----------|----------|  360
      TTTAATTGGAAACCCTGACCTTGTTCTGAGTGGTAGTATGGGTTATAGGTCTTGGGACTG

1: P  A  V  Y  Q  L  R  D (SEQ ID NO: 701)
      CCTGCCGTGTACCAGCTGAGAGACT(SEQ ID NO: 700)
361   ----------|----------|------ 385
      GGACGGCACATGGTCGACTCTCTGA(SEQ ID NO: 1529)
```

Figure 33a. SEQ23

```
TCR14 hTRBV11-2-CDR3 (ASSPTQGASYEQY)(SEQ ID NO: 115)
                                                                (SEQ ID NO: 1530)
GAA GCT GGA GTT GCC CAG TCT CCC AGA TAT AAG ATT ATA GAG AAA AGG CAG AGT GTG
gcttttttggtgcaatcctatatctggccatgctacccttactggtaccagcagatcctgggacagggcccaaagct
tctgattcagtttcagaataacGGTGTAGTGGATGATTCACAGTTGCCTAAGGATCGATTTTCTGCAGAGAGGCTCA
AAGGAGTAGACTCCACTCTCAAGATCCAGCCTGCAAAGCTTGAGGACTCGGCCGTGTATCTCTGTGCCAGCAGCCCG
ACGCAGGGGggtcctacgagcagtacttcgggccgggcaccaggctcacggtcacagaggacctgaaaaacgtgtt
cccacccgaggtcgctgtgtttgagccatcaga (SEQ ID NO: 1531)
```

```
    1: E   A   G   V   A   Q   S   P   R   Y   K   I   I   E   K   R   Q   S   V   A
          GAAGCTGGAGTTGCCCAGTCTCCCAGATATAAGATTATAGAGAAAAGGCAGAGTGTGGCT
    1  ----------|----------|----------|----------|----------|----------| 60
          CTTCGACCTCAACGGGTCAGAGGGTCTATATTCTAATATCTCTTTTCCGTCTCACACCGA

1: F   W   C   N   P   I   S   G   H   A   T   L   Y   W   Y   Q   Q   I   L   G
          TTTTGGTGCAATCCTATATCTGGCCATGCTACCCTTTACTGGTACCAGCAGATCCTGGGA
    61 ----------|----------|----------|----------|----------|----------| 120
          AAAACCACGTTAGGATATAGACCGGTACGATGGGAAATGACCATGGTCGTCTAGGACCCT

1: Q   G   P   K   L   L   I   Q   F   Q   N   N   G   V   V   D   D   S   Q   L
          CAGGGCCCAAAGCTTCTGATTCAGTTTCAGAATAACGGTGTAGTGGATGATTCACAGTTG
    121 ----------|----------|----------|----------|----------|----------| 180
          GTCCCGGGTTTCGAAGACTAAGTCAAAGTCTTATTGCCACATCACCTACTAAGTGTCAAC

1: P   K   D   R   F   S   A   E   R   L   K   G   V   D   S   T   L   K   I   Q
          CCTAAGGATCGATTTTCTGCAGAGAGGCTCAAAGGAGTAGACTCCACTCTCAAGATCCAG
    181 ----------|----------|----------|----------|----------|----------| 240
          GGATTCCTAGCTAAAAGACGTCTCTCCGAGTTTCCTCATCTGAGGTGAGAGTTCTAGGTC

1: P   A   K   L   E   D   S   A   V   Y   L   C   A   S   S   P   T   Q   G   A
          CCTGCAAAGCTTGAGGACTCGGCCGTGTATCTCTGTGCCAGCAGCCCGACGCAGGGGGCG
    241 ----------|----------|----------|----------|----------|----------| 300
          GGACGTTTCGAACTCCTGAGCCGGCACATAGAGACACGGTCGTCGGGCTGCGTCCCCGC

1: S   Y   E   Q   Y   F   G   P   G   T   R   L   T   V   T   E   D   L   K   N
          TCCTACGAGCAGTACTTCGGGCCGGGCACCAGGCTCACGGTCACAGAGGACCTGAAAAAC
    301 ----------|----------|----------|----------|----------|----------| 360
          AGGATGCTCGTCATGAAGCCCGGCCCGTGGTCCGAGTGCCAGTGTCTCCTGGACTTTTTG

1: V   F   P   P   E   V   A   V   F   E   P   S (SEQ ID NO: 703)
          GTGTTCCCACCCGAGGTCGCTGTGTTTGAGCCATCAGA (SEQ ID NO: 702)
    361 ----------|----------|----------|--------- 398
          CACAAGGGTGGGCTCCAGCGACACAAACTCGGTAGTCT (SEQ ID NO: 1532)
```

Figure 33b SEQ24

TCR14 :hTRAV3-CDR3 (AVRDAGYSTLT) (SEQ ID NO: 118)
(SEQ ID NO: 1533)
GCT CAG TCA GTG GCT CAG CCG GAA GAT CAG GTC AAC GTT GCT GAA GGG AAT CCT
ctgactgtgaaatgcacctattcagtctctggaaacccttatctttttggtatgttcaataccccaaccgaggcct
ccagttcctTCTGAAATACATCACAGGGGATAACCTGGTTAAAGGCAGCTATGGCTTTGAAGCTGAATTTAACAAGA
GCCAAACCTCCTTCCACCTGAAGAAACCATCTGCCCTTGTGAGCGACTCCGCTTTGTACTTCTGTGCTGTGAGAGAC
GCAGGATACAgcaccctcacctttgggaaggggactatgcttctagtctctccagatatccagaaccctgaccctgc
cgtgtaccagctgagagact(SEQ ID NO: 1534)

```
    1: A   Q   S   V   A   Q   P   E   D   Q   V   N   V   A   E   G   N   P   L   T
       GCTCAGTCAGTGGCTCAGCCGGAAGATCAGGTCAACGTTGCTGAAGGGAATCCTCTGACT
    1  ----------|----------|----------|----------|----------|----------|  60
       CGAGTCAGTCACCGAGTCGGCCTTCTAGTCCAGTTGCAACGACTTCCCTTAGGAGACTGA

1: V   K   C   T   Y   S   V   S   G   N   P   Y   L   F   W   Y   V   Q   Y   P
       GTGAAATGCACCTATTCAGTCTCTGGAAACCCTTATCTTTTTTGGTATGTTCAATACCCC
    61 ----------|----------|----------|----------|----------|----------|  120
       CACTTTACGTGGATAAGTCAGAGACCTTTGGGAATAGAAAAAACCATACAAGTTATGGGG

1: N   R   G   L   Q   F   L   L   K   Y   I   T   G   D   N   L   V   K   G   S
       AACCGAGGCCTCCAGTTCCTTCTGAAATACATCACAGGGGATAACCTGGTTAAAGGCAGC
    121 ----------|----------|----------|----------|----------|----------|  180
       TTGGCTCCGGAGGTCAAGGAAGACTTTATGTAGTGTCCCCTATTGGACCAATTTCCGTCG

1: Y   G   F   E   A   E   F   N   K   S   Q   T   S   F   H   L   K   K   P   S
       TATGGCTTTGAAGCTGAATTTAACAAGAGCCAAACCTCCTTCCACCTGAAGAAACCATCT
    181 ----------|----------|----------|----------|----------|----------|  240
       ATACCGAAACTTCGACTTAAATTGTTCTCGGTTTGGAGGAAGGTGGACTTCTTTGGTAGA

1: A   L   V   S   D   S   A   L   Y   F   C   A   V   R   D   A   G   Y   S   T
       GCCCTTGTGAGCGACTCCGCTTTGTACTTCTGTGCTGTGAGAGACGCAGGATACAGCACC
    241 ----------|----------|----------|----------|----------|----------|  300
       CGGGAACACTCGCTGAGGCGAAACATGAAGACACGACACTCTCTGCGTCCTATGTCGTGG

1: L   T   F   G   K   G   T   M   L   L   V   S   P   D   I   Q   N   P   D   P
       CTCACCTTTGGGAAGGGGACTATGCTTCTAGTCTCTCCAGATATCCAGAACCCTGACCCT
    301 ----------|----------|----------|----------|----------|----------|  360
       GAGTGGAAACCCTTCCCCTGATACGAAGATCAGAGAGGTCTATAGGTCTTGGGACTGGGA

1: A   V   Y   Q   L   R   D  (SEQ ID NO: 705)
       GCCGTGTACCAGCTGAGAGACT (SEQ ID NO: 704)
    361 ----------|----------|---  382
       CGGCACATGGTCGACTCTCTGA (SEQ ID NO: 1535)
```

Figure 34 SEQ25

```
TCR16:  hTRAV13-1-CDR3 (AASIDRDDKII)(SEQ ID NO: 119)
GGA GAG AAT GTG GAG CAG CAT CCT TCA ACC CTG AGT GTC CAG GAG GGA(SEQ ID NO: 1536)
gacagcgctgttatcaagtgcacttattcagacagtgcctcaaactacttcccttggtataagcaagaacttggaaa
aggacctcagctTATTATAGACATTCGTTCAAATGTGGGCGAAAAGAAAGACCAACGAATTGCTGTTACATTGAACA
AGACAGCCAAACATTTCTCCCTGCACATCACAGAGACCCAACCTGAAGACTCGGCTGTCTACTTCTGTGCAGCAAGT
ATCGACAgagatgacaagatcatctttggaaaagggacacgacttcatattctccccaatatccagaaccctgaccc
tgccgtgtaccagctgagagact (SEQ ID NO: 1537)
```

```
     1: G   E   N   V   E   Q   H   P   S   T   L   S   V   Q   E   G   D   S   A   V
        GGAGAGAATGTGGAGCAGCATCCTTCAACCCTGAGTGTCCAGGAGGGAGACAGCGCTGTT
     1  ----------|----------|----------|----------|----------|----------| 60
        CCTCTCTTACACCTCGTCGTAGGAAGTTGGGACTCACAGGTCCTCCCTCTGTCGCGACAA

1: I   K   C   T   Y   S   D   S   A   S   N   Y   F   P   W   Y   K   Q   E   L
        ATCAAGTGCACTTATTCAGACAGTGCCTCAAACTACTTCCCTTGGTATAAGCAAGAACTT
    61  ----------|----------|----------|----------|----------|----------| 120
        TAGTTCACGTGAATAAGTCTGTCACGGAGTTTGATGAAGGGAACCATATTCGTTCTTGAA

1: G   K   G   P   Q   L   I   I   D   I   R   S   N   V   G   E   K   K   D   Q
        GGAAAAGGACCTCAGCTTATTATAGACATTCGTTCAAATGTGGGCGAAAAGAAAGACCAA
   121  ----------|----------|----------|----------|----------|----------| 180
        CCTTTTCCTGGAGTCGAATAATATCTGTAAGCAAGTTTACACCCGCTTTTCTTTCTGGTT

1: R   I   A   V   T   L   N   K   T   A   K   H   F   S   L   H   I   T   E   T
        CGAATTGCTGTTACATTGAACAAGACAGCCAAACATTTCTCCCTGCACATCACAGAGACC
   181  ----------|----------|----------|----------|----------|----------| 240
        GCTTAACGACAATGTAACTTGTTCTGTCGGTTTGTAAAGAGGGACGTGTAGTGTCTCTGG

1: Q   P   E   D   S   A   V   Y   F   C   A   A   S   I   D   R   D   D   K   I
        CAACCTGAAGACTCGGCTGTCTACTTCTGTGCAGCAAGTATCGACAGAGATGACAAGATC
   241  ----------|----------|----------|----------|----------|----------| 300
        GTTGGACTTCTGAGCCGACAGATGAAGACACGTCGTTCATAGCTGTCTCTACTGTTCTAG

1: I   F   G   K   G   T   R   L   H   I   L   P   N   I   Q   N   P   D   P   A
        ATCTTTGGAAAAGGGACACGACTTCATATTCTCCCCAATATCCAGAACCCTGACCCTGCC
   301  ----------|----------|----------|----------|----------|----------| 360
        TAGAAACCTTTTCCCTGTGCTGAAGTATAAGAGGGGTTATAGGTCTTGGGACTGGGACGG

1: V   Y   Q   L   R   D (SEQ ID NO: 707)
        GTGTACCAGCTGAGAGACT(SEQ ID NO: 706)
   361  ----------|---------- 379
        CACATGGTCGACTCTCTGA (SEQ ID NO: 1538)
```

Figure 35a. SEQ28

TCR17: hTRBV28-CDR3 (ATTQGSYNEQF) (SEQ ID NO: 122)

GAT GTG AAA GTA ACC CAG AGC TCG AGA TAT CTA GTC AAA AGG ACG GGA(SEQ ID NO: 1539)
gagaaagttttctggaatgtgtccaggatatggaccatgaaaatatgttctggtatcgacaagacccaggtctggg
gctacggctgatctatttctcaTATGATGTTAAAATGAAAGAAAAAGGAGATATTCCTGAGGGTACAGTGTCTCTA
GAGAGAAGAAGGAGCGCTTCTCCCTGATTCTGGAGTCCGCCAGCACCAACCAGACATCTATGTACCTCTGTGCCACT
ACTCAggggtcctacaatgagcagttcttcgggccagggacacggctcaccgtgctagaggacctgaaaaacgtgtt
cccacccgaggtcgctgtgtttgagccatcaga (SEQ ID NO: 1540)

```
       1: D   V   K   V   T   Q   S   S   R   Y   L   V   K   R   T   G   E   K   V   F
          GATGTGAAAGTAACCCAGAGCTCGAGATATCTAGTCAAAACGACGGGAGAGAAAGTTTTT
       1  ----------!----------!----------!----------!----------!----------! 60
          CTACACTTTCATTGGGTCTCGAGCTCTATAGATCAGTTTTGCTGCCCTCTCTTTCAAAAA

1: L   E   C   V   Q   D   M   D   H   E   N   M   F   W   Y   R   Q   D   P   G
          CTGGAATGTGTCCAGGATATGGACCATGAAAATATGTTCTGGTATCGACAAGACCCAGGT
      61  ----------!----------!----------!----------!----------!----------! 120
          GACCTTACACAGGTCCTATACCTGGTACTTTTATACAAGACCATAGCTGTTCTGGGTCCA

1: L   G   L   R   L   I   Y   F   S   Y   D   V   K   M   K   E   K   G   D   I
          CTGGGGCTACGGCTGATCTATTTCTCATATGATGTTAAAATGAAAGAAAAAGGAGATATT
     121  ----------!----------!----------!----------!----------!----------! 180
          GACCCCGATGCCGACTAGATAAAGAGTATACTACAATTTTACTTTCTTTTTCCTCTATAA

1: P   E   G   Y   S   V   S   R   E   K   K   E   R   F   S   L   I   L   E   S
          CCTGAGGGGTACAGTGTCTCTAGAGAAGAAGGAGCGCTTCTCCCTGATTCTGGAGTCC
     181  ----------!----------!----------!----------!----------!----------! 240
          GGACTCCCCATGTCACAGAGATCTCTCTTCTTCCTCGCGAAGAGGGACTAAGACCTCAGG

1: A   S   T   N   Q   T   S   M   Y   L   C   A   T   T   Q   G   S   Y   N   E
          GCCAGCACCAACCAGACATCTATGTACCTCTGTGCCACTACTCAGGGGTCCTACAATGAG
     241  ----------!----------!----------!----------!----------!----------! 300
          CGGTCGTGGTTGGTCTGTAGATACATGGAGACACGGTGATGAGTCCCCAGGATGTTACTC

1: Q   F   F   G   P   G   T   R   L   T   V   L   E   D   L   K   N   V   F   P
          CAGTTCTTCGGGCCAGGGACACGGCTCACCGTGCTAGAGGACCTGAAAAACGTGTTCCCA
     301  ----------!----------!----------!----------!----------!----------! 360
          GTCAAGAAGCCCGGTCCCTGTGCCGAGTGGCACGATCTCCTGGACTTTTTGCACAAGGGT

1: P   E   V   A   V   F   E   P   S (SEQ ID NO: 709)
          CCCGAGGTCGCTGTGTTTGAGCCATCAGA(SEQ ID NO: 708)
     361  ----------!----------!--------- 389
          GGGCTCCAGCGACACAAACTCGGTAGTCT (SEQ ID NO: 1541)
```

Figure 35b. SEQ27

TCR17: hTRAV20-CDR3 (AVQAGSYIPT) (SEQ ID NO: 125)

GAA GAC CAG GTG ACG CAG AGT CCC GAG GCC CTG AGA (SEQ ID NO: 1542)
ctccaggagggagagagtagcagtctcaactgcagttacacagtcagcggtttaagagggctgttctggtataggca
agatcctgggaaaggCCCTGAATTCCTCTTCACCCTGTATTCAGCTGGGGAAGAAAAGGAGAAAGAAAGGCTAAAAG
CCACATTAACAAAGAAGGAAAGCTTTCTGCACATCACAGCCCCTAAACCTGAAGACTCAGCCACTTATCTCTGTGct
gtgcaggctggaagctacatacctacatttggaagaggaaccagccttattgttcatccgtatatccagaaccctga
ccctgccgtgtaccagctgagagact (SEQ ID NO: 1543)

```
 1: E   D   Q   V   T   Q   S   P   E   A   L   R   L   Q   E   G   E   S   S   S
    GAAGACCAGGTGACGCAGAGTCCCGAGGCCCTGAGACTCCAGGAGGGAGAGAGTAGCAGT
 1  ----------|----------|----------|----------|----------|----------|  60
    CTTCTGGTCCACTGCGTCTCAGGGCTCCGGGACTCTGAGGTCCTCCCTCTCTCATCGTCA

1: L   N   C   S   Y   T   V   S   G   L   R   G   L   F   W   Y   R   Q   D   P
    CTCAACTGCAGTTACACAGTCAGCGGTTTAAGAGGGCTGTTCTGGTATAGGCAAGATCCT
61  ----------|----------|----------|----------|----------|----------|  120
    GAGTTGACGTCAATGTGTCAGTCGCCAAATTCTCCCGACAAGACCATATCCGTTCTAGGA

1: G   K   G   P   E   F   L   F   T   L   Y   S   A   G   E   E   K   E   K   E
    GGGAAAGGCCCTGAATTCCTCTTCACCCTGTATTCAGCTGGGGAAGAAAAGGAGAAAGAA
121 ----------|----------|----------|----------|----------|----------|  180
    CCCTTTCCGGGACTTAAGGAGAAGTGGGACATAAGTCGACCCCTTCTTTTCCTCTTTCTT

1: R   L   K   A   T   L   T   K   K   E   S   F   L   H   I   T   A   P   K   P
    AGGCTAAAAGCCACATTAACAAAGAAGGAAAGCTTTCTGCACATCACAGCCCCTAAACCT
181 ----------|----------|----------|----------|----------|----------|  240
    TCCGATTTTCGGTGTAATTGTTTCTTCCTTTCGAAAGACGTGTAGTGTCGGGGATTTGGA

1: E   D   S   A   T   Y   L   C   A   V   Q   A   G   S   Y   I   P   T   F   G
    GAAGACTCAGCCACTTATCTCTGTGCTGTGCAGGCTGGAAGCTACATACCTACATTTGGA
241 ----------|----------|----------|----------|----------|----------|  300
    CTTCTGAGTCGGTGAATAGAGACACGACACGTCCGACCTTCGATGTATGGATGTAAACCT

1: R   G   T   S   L   I   V   H   P   Y   I   Q   N   P   D   P   A   V   Y   Q
    AGAGGAACCAGCCTTATTGTTCATCCGTATATCCAGAACCCTGACCCTGCCGTGTACCAG
301 ----------|----------|----------|----------|----------|----------|  360
    TCTCCTTGGTCGGAATAACAAGTAGGCATATAGGTCTTGGGACTGGGACGGCACATGGTC

1: L   R   D   (SEQ ID NO: 711)
    CTGAGAGACT (SEQ ID NO: 710)
361 ----------|  370
    GACTCTCTGA (SEQ ID NO: 1544)
```

Figure 36 TREE MAP
A) TRA CFSE-High
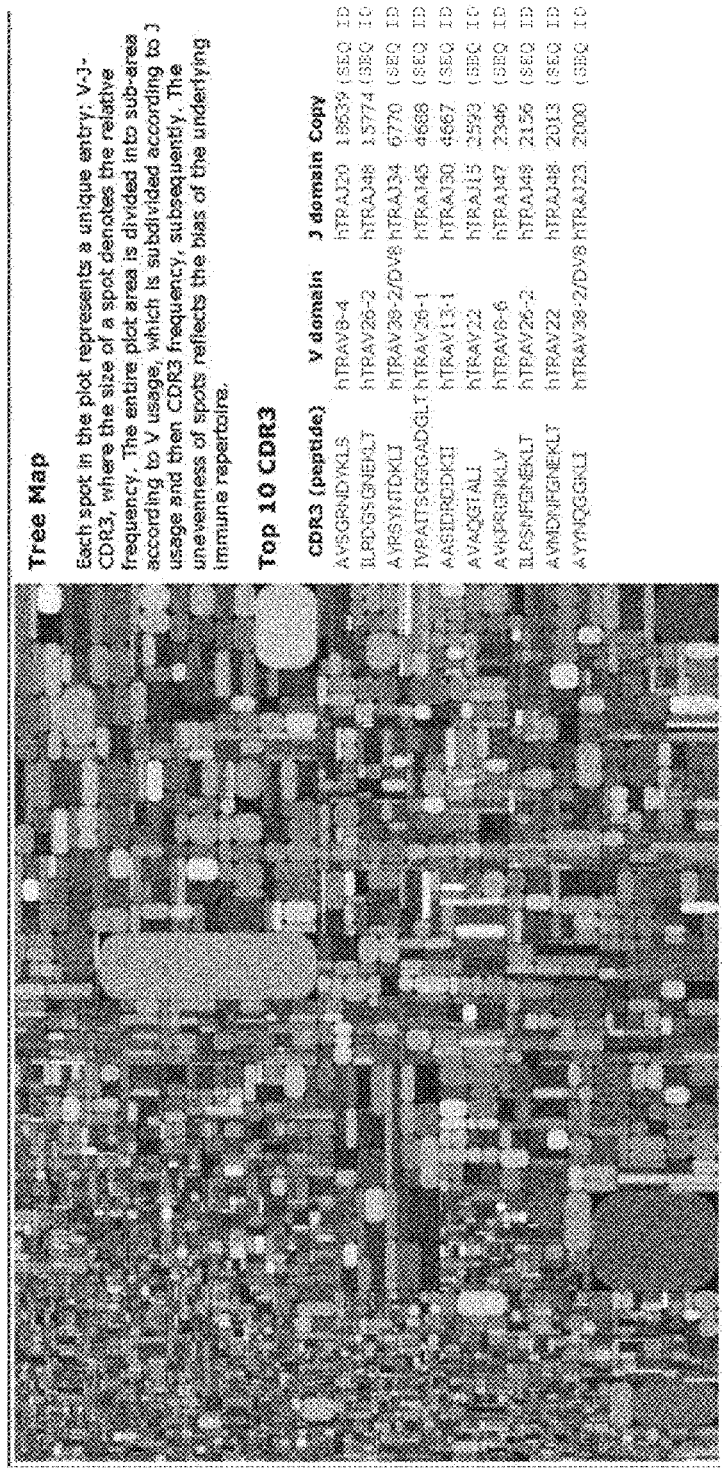

Figure 36 contd

B) TRA CFSE-Low

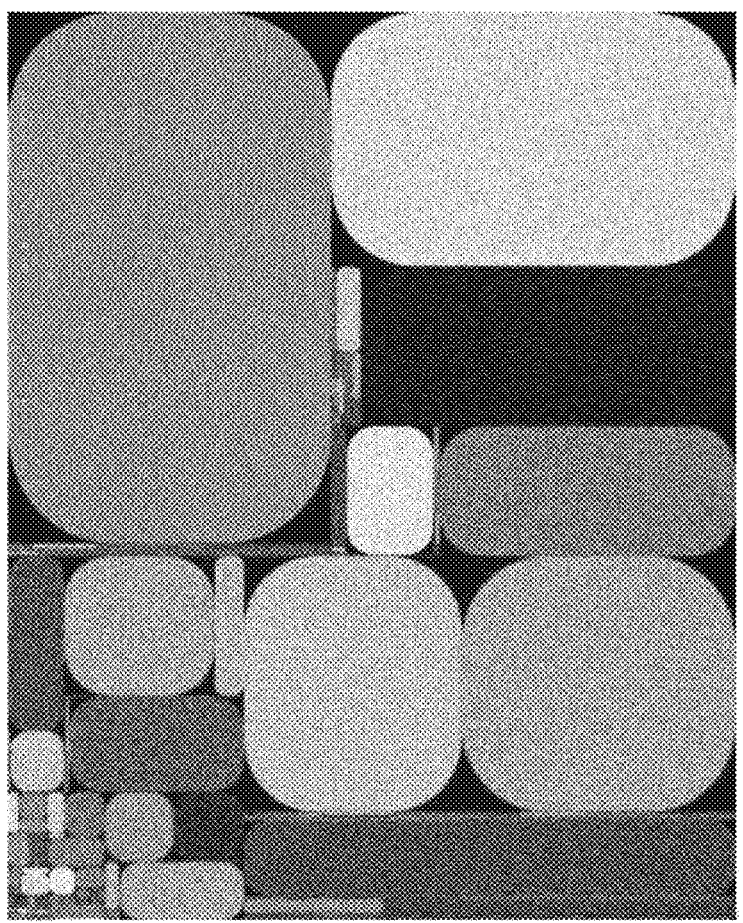

Tree Map

Each spot in the plot represents a unique entry: V-J-CDR3, where the size of a spot denotes the relative frequency. The entire plot area is divided into sub-areas according to V usage, which is subdivided according to J usage and then CDR3 frequency, subsequently. The unevenness of spots reflects the bias of the underlying immune repertoire.

Top 10 CDR3

| CDR3 (peptide) | V domain | J domain | Copy | |
|---|---|---|---|---|
| AVSGRNDYKLS | hTRAV8-4 | hTRAJ20 | 226826 | (SEQ ID NO: 129) |
| ILRDGSBHEKLT | hTRAV26-2 | hTRAJ46 | 132371 | (SEQ ID NO: 133) |
| AASIDRDDKII | hTRAV13-1 | hTRAJ30 | 89636 | (SEQ ID NO: 119) |
| ILRSNFGNEKLT | hTRAV26-2 | hTRAJ48 | 76370 | (SEQ ID NO: 145) |
| AVWPRGNKLV | hTRAV8-6 | hTRAJ47 | 71493 | (SEQ ID NO: 714) |
| ILRDVYDYKLS | hTRAV26-2 | hTRAJ20 | 49471 | (SEQ ID NO: 90) |
| IVRVGYNNNDMR | hTRAV26-1 | hTRAJ43 | 48453 | (SEQ ID NO: 155) |
| ALGQTGANNLF | hTRAV6 | hTRAJ36 | 26790 | (SEQ ID NO: 147) |
| VVTLIGGFKTI | hTRAV12-1 | hTRAJ9 | 21420 | (SEQ ID NO: 7179) |
| ILRAQGGSEHLV | hTRAV26-2 | hTRAJ57 | 14484 | (SEQ ID NO: 157) |

Figure 36 cont'd

C) TRB CFSE-High

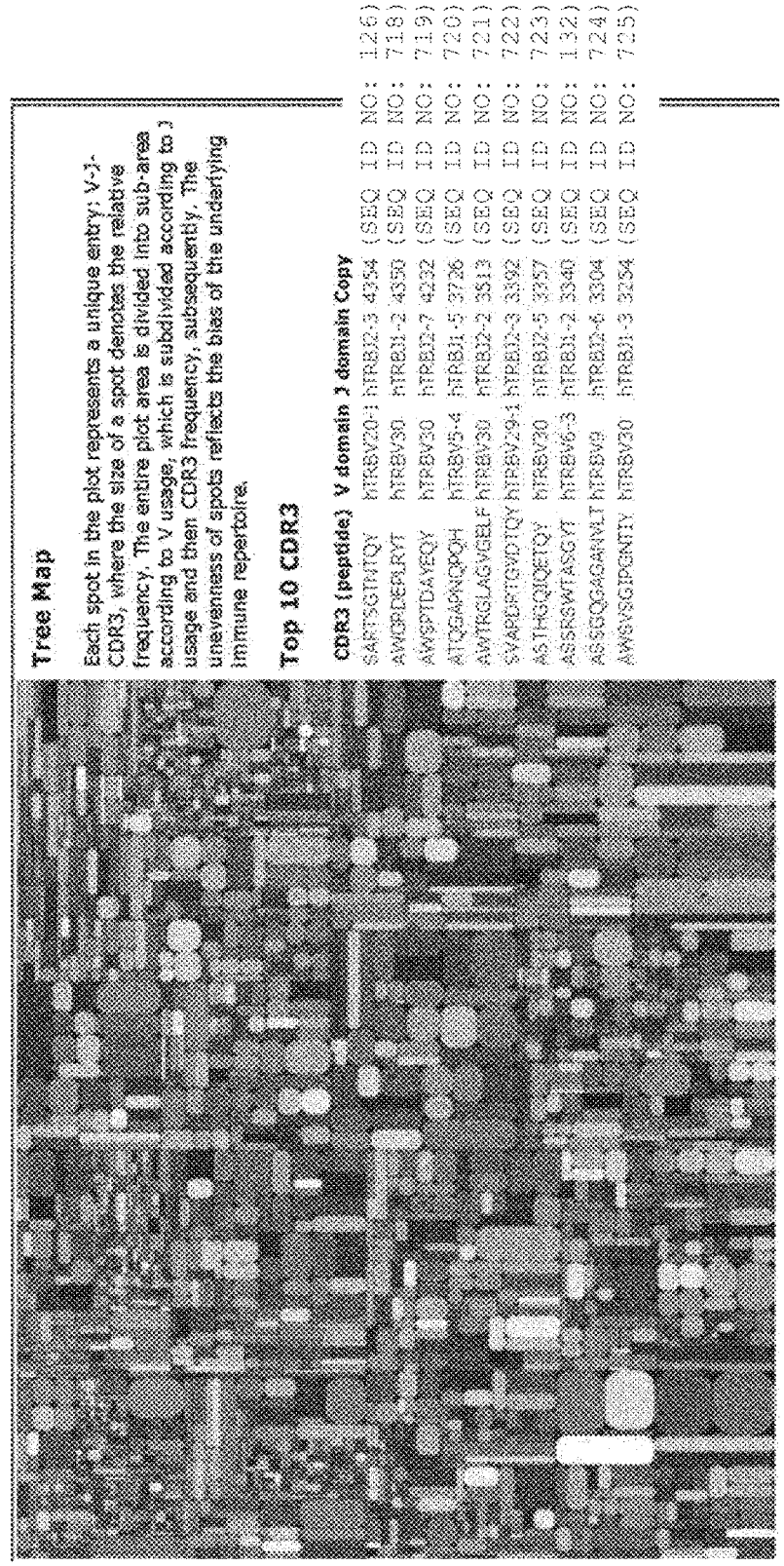

Tree Map

Each spot in the plot represents a unique entry: V-J-CDR3, where the size of a spot denotes the relative frequency. The entire plot area is divided into sub-areas according to V usage, which is subdivided according to J usage and then CDR3 frequency, subsequently. The unevenness of spots reflects the bias of the underlying immune repertoire.

Top 10 CDR3

| CDR3 (peptide) | V domain | J domain | Copy | | |
|---|---|---|---|---|---|
| SARTSGTMTQY | hTRBV20-1 | hTRBJ2-3 | 4354 | (SEQ ID NO: | 126) |
| AWDRDEPLRYT | hTRBV30 | hTRBJ1-2 | 4350 | (SEQ ID NO: | 718) |
| AWSPTDAYEQY | hTRBV30 | hTRBJ2-7 | 4232 | (SEQ ID NO: | 719) |
| ATGSAPNQPQH | hTRBV5-4 | hTRBJ1-5 | 3726 | (SEQ ID NO: | 720) |
| AWTRGSLAGVGELF | hTRBV30 | hTRBJ2-2 | 3513 | (SEQ ID NO: | 721) |
| SVAPDFTGVDTQY | hTRBV29-1 | hTRBJ2-3 | 3392 | (SEQ ID NO: | 722) |
| ASTHGQIQETQY | hTRBV30 | hTRBJ2-5 | 3357 | (SEQ ID NO: | 723) |
| ASSRSWTASGYT | hTRBV6-3 | hTRBJ1-2 | 3340 | (SEQ ID NO: | 132) |
| ASSQQGAGANVLT | hTRBV9 | hTRBJ2-6 | 3304 | (SEQ ID NO: | 724) |
| AWSVSGIPGNTIY | hTRBV30 | hTRBJ1-3 | 3254 | (SEQ ID NO: | 725) |

Figure 36 contd

D) TRB CFSE-Low

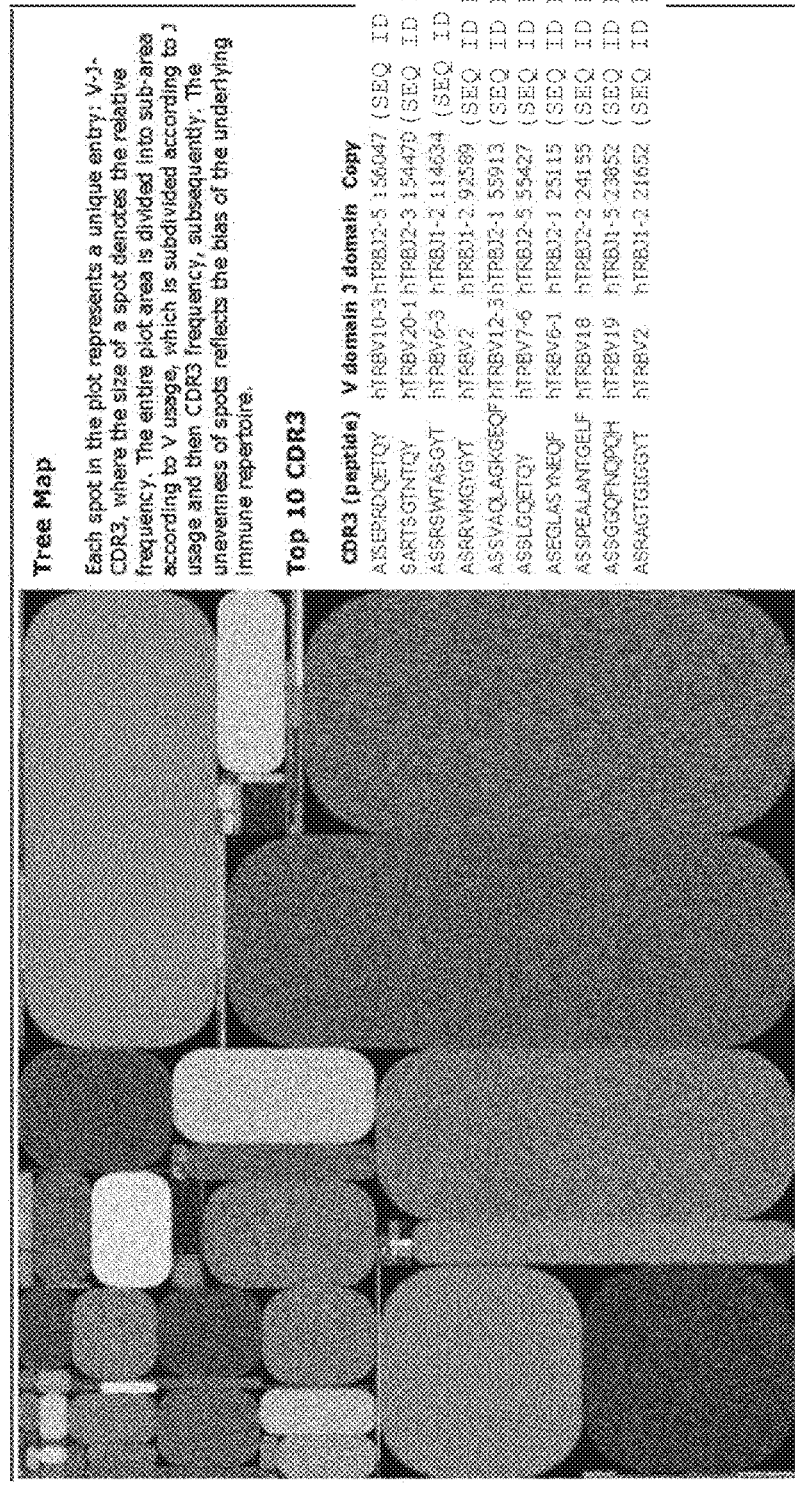

Tree Map

Each spot in the plot represents a unique entry: V-J-CDR3, where the size of a spot denotes the relative frequency. The entire plot area is divided into sub-area according to V usage, which is subdivided according to J usage and then CDR3 frequency, subsequently. The unevenness of spots reflects the bias of the underlying immune repertoire.

Top 10 CDR3

| CDR3 (peptide) | V domain | J domain | Copy | |
|---|---|---|---|---|
| ASEPRDQETQY | hTRBV10-3 | hTRBJ2-5 | 156047 | (SEQ ID NO: 87) |
| SARTSGTNTQY | hTRBV20-1 | hTRBJ2-3 | 154470 | (SEQ ID NO: 126) |
| ASSRSWTAGGT | hTRBV6-3 | hTRBJ1-2 | 114634 | (SEQ ID NO: 132) |
| ASRRVMGYGYT | hTRBV2 | hTRBJ1-2 | 92589 | (SEQ ID NO: 138) |
| ASSVAQLAGHGEQF | hTRBV12-3 | hTRBJ2-1 | 55913 | (SEQ ID NO: 135) |
| ASBLGQETQY | hTRBV7-6 | hTRBJ2-5 | 55427 | (SEQ ID NO: 726) |
| ASEGLASYNEQF | hTRBV6-1 | hTRBJ2-1 | 25115 | (SEQ ID NO: 176) |
| ASSPEALANTGELF | hTRBV18 | hTRBJ2-2 | 24155 | (SEQ ID NO: 150) |
| ASSGSGQFNQPQH | hTRBV19 | hTRBJ1-5 | 23852 | (SEQ ID NO: 144) |
| ASRAGTGKGGYT | hTRBV2 | hTRBJ1-2 | 21652 | (SEQ ID NO: 158) |

Figure 37a. SEQ28

TCR19: hTRBV20-1-CDR3 (SARTSGTNTQY). (SEQ ID NO: 126)

```
GGT GCT GTC GTC TCT CAA CAT CCG AGC TGG GTT ATC TGT AAG AGT GGA ACC TCT (SEQ ID NO: 1507)
gtgaagatcgagtgccgttccctggactttcaggccacaactatgttttggtatcgtcagttcccgaaacagagtctcatgctgatggcaacttccaatg
agGGCTCCAAGGCCACATACGAGCAAGGCGTCGAGAAGGACAAGTTTCTCATCAACCATGCAAGCCTGACCTTGTC
CACTCTGACAGTGACCAGTGCCCATCCTGAAGACAGCAGCTTCTACATCTGCAGTGCTCGGACTAgcgggacgaatacg
cagtattttggcccaggcacccggctgacagtgctcgaggacctgaaaaacgtgttcccacccgaggtcgctgtgtttgagccatcaga
```
(SEQ ID NO: 1545)

```
  1: G   A   V   V   S   Q   H   P   S   W   V   I   C   K   S   G   T   S   V   K
        GGTGCTGTCGTCTCTCAACATCCGAGCTGGGTTATCTGTAAGAGTGGAACCTCTGTGAAG
  1     ----------|----------|----------|----------|----------|----------| 60
        CCACGACAGCAGAGAGTTGTAGGCTCGACCCAATAGACATTCTCACCTTGGAGACACTTC

1: I   E   C   R   S   L   D   F   Q   A   T   T   M   F   W   Y   R   Q   F   P
        ATCGAGTGCCGTTCCTGGACTTTCAGGCCACAACTATGTTTTGGTATCGTCAGTTCCCG
 61     ----------|----------|----------|----------|----------|----------| 120
        TAGCTCACGGCAAGGACCTGAAAGTCCGGTGTTGATACAAAACCATAGCAGTCAAGGGC

1: K   Q   S   L   M   L   M   A   T   S   N   E   G   S   K   A   T   Y   E   Q
        AAACAGAGTCTCATGCTGATGGCAACTTCCAATGAGGGCTCCAAGGCCACATACGAGCAA
121     ----------|----------|----------|----------|----------|----------| 180
        TTTGTCTCAGAGTACGACTACCGTTGAAGGTTACTCCCGAGGTTCCGGTGTATGCTCGTT

1: G   V   E   K   D   K   F   L   I   N   H   A   S   L   T   L   S   T   L   T
        GGCGTCGAGAAGGACAAGTTTCTCATCAACCATGCAAGCCTGACCTTGTCCACTCTGACA
181     ----------|----------|----------|----------|----------|----------| 240
        CCGCAGCTCTTCCTGTTCAAAGAGTAGTTGGTACGTTCGGACTGGAACAGGTGAGACTGT

1: V   T   S   A   H   P   E   D   S   S   F   Y   I   C   S   A   R   T   S   G
        GTGACCAGTGCCCATCCTGAAGACAGCAGCTTCTACATCTGCAGTGCTCGGACTAGCGGG
241     ----------|----------|----------|----------|----------|----------| 300
        CACTGGTCACGGGTAGGACTTCTGTCGTCGAAGATGTAGACGTCACGAGCCTGATCGCCC

1: T   N   T   Q   Y   F   G   P   G   T   R   L   T   V   L   E   D   L   K   N
        ACGAATACGCAGTATTTTGGCCCAGGCACCCGGCTGACAGTGCTCGAGGACCTGAAAAAC
301     ----------|----------|----------|----------|----------|----------| 360
        TGCTTATGCGTCATAAAACCGGGTCCGTGGGCCGACTGTCACGAGCTCCTGGACTTTTTG

1: V   F   P   P   E   V   A   V   F   E   P   S (SEQ ID NO: 728)
        GTGTTCCCACCCGAGGTCGCTGTGTTTGAGCCATCAGA (SEQ ID NO: 727)
361     ----------|----------|----------|---------- 398
        CACAAGGGTGGGCTCCAGCGACACAAACTCGGTAGTCT (SEQ ID NO: 1546)
```

Figure 37b. SEQ29

TCR19: hTRAV8-4-CDR3 (AVSGRNDYKLS) (SEQ ID NO: 129)

GCC CAG TCG GTG ACC CAG CTT GGC AGC CAC GTC TCT GTC TCT GAA GGA GCC CTG GTT (SEQ ID NO: 1547)
ctgctgaggtgcaactactcatcgtctgttccaccatatctcttctggtatgtgcaataccccaaccaaggactccagcttctCCTGAAGTACACAT
CAGCGGCCACCCTGGTTAAAGGCATCAACGGTTTTGAGGCTGAATTTAAGAAGAGTGAAACCTCCTTCCACCTGAC
GAAACCCTCAGCCCATATGAGCGACGCGGCTGAGTACTTCTGTGCTGTGAGCGGTCGTAacgactacaagctcagctttg
gagccggaaccacagtaactgtaagagcaaatatccagaaccctgaccctgccgtgtaccagctgagagact (SEQ ID NO: 1548)

```
 1: A  Q  S  V  T  Q  L  G  S  H  V  S  V  S  E  G  A  L  V  L
    GCCCAGTCGGTGACCCAGCTTGGCAGCCACGTCTCTGTCTCTGAAGGAGCCCTGGTTCTG
  1 ----------|----------|----------|----------|----------|----------| 60
    CGGGTCAGCCACTGGGTCGAACCGTCGGTGCAGAGACAGAGACTTCCTCGGGACCAAGAC

1: L  R  C  N  Y  S  S  S  V  P  P  Y  L  F  W  Y  V  Q  Y  P
    CTGAGGTGCAACTACTCATCGTCTGTTCCACCATATCTCTTCTGGTATGTGCAATACCCC
 61 ----------|----------|----------|----------|----------|----------| 120
    GACTCCACGTTGATGAGTAGCAGACAAGGTGGTATAGAGAAGACCATACACGTTATGGGG

1: N  Q  G  L  Q  L  L  L  K  Y  T  S  A  A  T  L  V  K  G  I
    AACCAAGGACTCCAGCTTCTCCTGAAGTACACATCAGCGGCCACCCTGGTTAAAGGCATC
121 ----------|----------|----------|----------|----------|----------| 180
    TTGGTTCCTGAGGTCGAAGAGGACTTCATGTGTAGTCGCCGGTGGGACCAATTTCCGTAG

1: N  G  F  E  A  E  F  K  K  S  E  T  S  F  H  L  T  K  P  S
    AACGGTTTTGAGGCTGAATTTAAGAAGAGTGAAACCTCCTTCCACCTGACGAAACCCTCA
181 ----------|----------|----------|----------|----------|----------| 240
    TTGCCAAAACTCCGACTTAAATTCTTCTCACTTTGGAGGAAGGTGGACTGCTTTGGGAGT

1: A  H  M  S  D  A  A  E  Y  F  C  A  V  S  G  R  N  D  Y  K
    GCCCATATGAGCGACGCGGCTGAGTACTTCTGTGCTGTGAGCGGTCGTAACGACTACAAG
241 ----------|----------|----------|----------|----------|----------| 300
    CGGGTATACTCGCTGCGCCGACTCATGAAGACACGACACTCGCCAGCATTGCTGATGTTC

1: L  S  F  G  A  G  T  T  V  T  V  R  A  N  I  Q  N  P  D  P
    CTCAGCTTTGGAGCCGGAACCACAGTAACTGTAAGAGCAAATATCCAGAACCCTGACCCT
301 ----------|----------|----------|----------|----------|----------| 360
    GAGTCGAAACCTCGGCCTTGGTGTCATTGACATTCGTTTATAGGTCTTGGGACTGGGA

1: A  V  Y  Q  L  R  D  (SEQ ID NO: 730)
    GCCGTGTACCAGCTGAGAGACT (SEQ ID NO: 729)
361 ----------|----------|--- 382
    CGGCACATGGTCGACTCTCTGA (SEQ ID NO: 1549)
```

Figure 38a. SEQ30

TCR20: hTRBV6-3-CDR3 (ASSRSWTASGYT) (SEQ ID NO: 132)

AAT GCT GGT GTC ACT CAG ACC CCA AAA TTC CGG GTC CTG AAG ACA GGA CAG (SEQ ID NO: 1550)
agcatgacactgctgtgtgcccaggatatgaaccatgaatacatgtactggtatcgacaagacccaggcatggggctgaggctgattcattactcagtt
GGTGAGGGTACAACTGCCAAAGGAGAGGTCCCTGATGGCTACAATGTCTCCAGATTAAAAAAACAGAATTTCCTG
CTGGGGTTGGAGTCGGCTGCTCCCTCCCAAACATCTGTGTACTTCTGTGCCAGCAGTCGCTCCTGGAcagcaagtggct
acaccttcggttcggggaccaggttaaccgttgtagaggacctgaacaaggtgttcccacccgaggtcgctgtgtttgagccatcaga
(SEQ ID NO: 1551)

```
  1: N   A   G   V   T   Q   T   P   K   F   R   V   L   K   T   G   Q   S   M   T
     AATGCTGGTGTCACTCAGACCCCAAAATTCCGGGTCCTGAAGACAGGACAGAGCATGACA
  1  ----------|----------|----------|----------|----------|----------| 60
     TTACGACCACAGTGAGTCTGGGGTTTTAAGGCCCAGGACTTCTGTCCTGTCTCGTACTGT

1: L   L   C   A   Q   D   M   N   H   E   Y   M   Y   W   Y   R   Q   D   P   G
     CTGCTGTGTGCCCAGGATATGAACCATGAATACATGTACTGGTATCGACAAGACCCAGGC
 61  ----------|----------|----------|----------|----------|----------| 120
     GACGACACACGGGTCCTATACTTGGTACTTATGTACATGACCATAGCTGTTCTGGGTCCG

1: M   G   L   R   L   I   H   Y   S   V   G   E   G   T   A   K   G   E   V
     ATGGGGCTGAGGCTGATTCATTACTCAGTTGGTGAGGGTACAACTGCCAAAGGAGAGGTC
121  ----------|----------|----------|----------|----------|----------| 180
     TACCCCGACTCCGACTAAGTAATGAGTCAACCACTCCCATGTTGACGGTTTCCTCTCCAG

1: P   D   G   Y   N   V   S   R   L   K   K   Q   N   F   L   L   G   L   E   S
     CCTGATGGCTACAATGTCTCCAGATTAAAAAAACAGAATTTCCTGCTGGGGTTGGAGTCG
181  ----------|----------|----------|----------|----------|----------| 240
     GGACTACCGATGTTACAGAGGTCTAATTTTTTTGTCTTAAAGGACGACCCCAACCTCAGC

1: A   A   P   S   Q   T   S   V   Y   F   C   A   S   S   R   S   W   T   A   S
     GCTGCTCCCTCCCAAACATCTGTGTACTTCTGTGCCAGCAGTCGCTCCTGGACAGCAAGT
241  ----------|----------|----------|----------|----------|----------| 300
     CGACGAGGGAGGGTTTGTAGACACATGAAGACACGGTCGTCAGCGAGGACCTGTCGTTCA

1: G   Y   T   F   G   S   G   T   R   L   T   V   V   E   D   L   N   K   V   F
     GGCTACACCTTCGGTTCGGGGACCAGGTTAACCGTTGTAGAGGACCTGAACAAGGTGTTC
301  ----------|----------|----------|----------|----------|----------| 360
     CCGATGTGGAAGCCAAGCCCCTGGTCCAATTGGCAACATCTCCTGGACTTGTTCCACAAG

1: P   P   E   V   A   V   F   E   P   S  (SEQ ID NO: 732)
     CCACCCGAGGTCGCTGTGTTTGAGCCATCAGA (SEQ ID NO: 731)
361  ----------|----------|----------| --  392
     GGTGGGCTCCAGCGACACAAACTCGGTAGTCT (SEQ ID NO: 1552)
```

Figure 38b. SEQ31

TCR20: hTRAV26-2-CDR3 (ILRDGSGNEKLT) (SEQ ID NO: 133)

GAT GCT AAG ACC ACA CAG CCA AAT TCA ATG GAG AGT AAC GAA GAA GAG (SEQ ID NO: 1553)
cctgttcacttgccttgtaaccactccacaatcagtggaactgattacatacattggtatcgacagcttcctcccagggtccagaGTACGTGATTC
ATGGTCTTACAAGCAATGTGAACAACAGAATGGCCTCTCTGGCAATCGCTGAAGACAGAAAGTCCAGTACCTTGAT
CCTGCACCGTGCTACCTTGAGAGATGCTGCTGTGTACTACTGCATCCTGAGAGACGGGTCCGGaaatgagaaattaacc
tttgggactggaacaagactcaccatcatacccaatatccagaaccctgaccctgccgtgtaccagctgagagact (SEQ ID NO: 1554)

```
1: D  A  K  T  T  Q  P  N  S  M  E  S  N  E  E  P  V  H  L
   GATGCTAAGACCACACAGCCAAATTCAATGGAGAGTAACGAAGAAGAGCCTGTTCACTTG
 1 ----------!----------!----------!----------!----------!----------! 60
   CTACGATTCTGGTGTGTCGGTTTAAGTTACCTCTCATTGCTTCTTCTCGGACAAGTGAAC

1: P  C  N  H  S  T  I  S  G  T  D  Y  I  H  W  Y  R  Q  L  P
   CCTTGTAACCACTCCACAATCAGTGGAACTGATTACATACATTGGTATCGACAGCTTCCC
61 ----------!----------!----------!----------!----------!----------! 120
   GGAACATTGGTGAGGTGTTAGTCACCTTGACTAATGTATGTAACCATAGCTGTCGAAGGG

1: S  Q  G  P  E  Y  V  I  H  G  L  T  S  N  V  N  N  R  M  A
    TCCCAGGGTCCAGAGTACGTGATTCATGGTCTTACAAGCAATGTGAACAACAGAATGGCC
121 ----------!----------!----------!----------!----------!----------! 180
    AGGGTCCCAGGTCTCATGCACTAAGTACCAGAATGTTCGTTACACTTGTTGTCTTACCGG

1: S  L  A  I  A  E  D  R  K  S  S  T  L  I  L  H  R  A  T  L
    TCTCTGGCAATCGCTGAAGACAGAAAGTCCAGTACCTTGATCCTGCACCGTGCTACCTTG
181 ----------!----------!----------!----------!----------!----------! 240
    AGAGACCGTTAGCGACTTCTGTCTTTCAGGTCATGGAACTAGGACGTGGCACGATGGAAC

1: R  D  A  A  V  Y  Y  C  I  L  R  D  G  S  G  N  E  K  L  T
    AGAGATGCTGCTGTGTACTACTGCATCCTGAGAGACGGGTCCGGAAATGAGAAATTAACC
241 ----------!----------!----------!----------!----------!----------! 300
    TCTCTACGACGACACATGATGACGTAGGACTCTCTGCCCAGGCCTTTACTCTTTAATTGG

1: F  G  T  G  T  R  L  T  I  I  P  N  I  Q  N  P  D  P  A  V
    TTTGGGACTGGAACAAGACTCACCATCATACCCAATATCCAGAACCCTGACCCTGCCGTG
301 ----------!----------!----------!----------!----------!----------! 360
    AAACCCTGACCTTGTTCTGAGTGGTAGTATGGGTTATAGGTCTTGGGACTGGGACGGCAC

1: Y  Q  L  R  D (SEQ ID NO: 734)
    TACCAGCTGAGAGACT (SEQ ID NO: 733)
361 ----------!------- 376
    ATGGTCGACTCTCTGA (SEQ ID NO: 1555)
```

Figure 39a. SEQ32

TCR21: hTRBV12-3-CDR3 (ASSVAQLAGKGEQF) (SEQ ID NO: 135)

```
GAT GCT GGA GTT ATC CAG TCA CCC CGC CAT GAG GTG ACA GAG ATG GGA CAA GAA (SEQ ID NO: 1556)
gtgactctgagatgtaaaccaatttcaggccacaactcccttttctggtacagacagaccatgatgcggggactggagttgctcatttactttaacaaca
acgttCCGATAGATGATTCAGGGATGCCCGAGGATCGATTCTCAGCTAAGATGCCTAATGCATCATTCTCCACTCTGA
AGATCCAGCCCTCAGAACCCAGGGACTCAGCTGTGTACTTCTGTGCCAGCAGTGTGGCCCAActagcgggaaagggtga
gcagttcttcgggccagggacacggctcaccgtgctagaggacctgaaaaacgtgttcccacccgaggtcgctgtgtttgagccatcaga
                                                                    (SEQ ID NO: 1557)
```

```
1:    D  A  G  V  I  Q  S  P  R  H  E  V  T  E  M  G  Q  E  V  T
      GATGCTGGAGTTATCCAGTCACCCCGCCATGAGGTGACAGAGATGGGACAAGAAGTGACT
 1    ----------!----------!----------!----------!----------!----------!  60
      CTACGACCTCAATAGGTCAGTGGGGCGGTACTCCACTGTCTCTACCCTGTTCTTCACTGA

1:    L  R  C  K  P  I  S  G  H  N  S  L  F  W  Y  R  Q  T  M  M
      CTGAGATGTAAACCAATTTCAGGCCACAACTCCCTTTTCTGGTACAGACAGACCATGATG
 61   ----------!----------!----------!----------!----------!----------!  120
      GACTCTACATTTGGTTAAAGTCCGGTGTTGAGGGAAAAGACCATGTCTGTCTGGTACTAC

1:    P  G  L  E  L  L  I  Y  F  N  N  N  V  P  I  D  D  S  G  M
      CCGGGGACTGGAGTTGCTCATTTACTTTAACAACAACGTTCCGATAGATGATTCAGGGATG
 121  ----------!----------!----------!----------!----------!----------!  180
      GCCCCTGACCTCAACGAGTAAATGAAATTGTTGTTGCAAGGCTATCTACTAAGTCCCTAC

1:    P  E  D  R  F  S  A  K  M  P  N  A  S  F  S  T  L  K  I  Q
      CCCGAGGATCGATTCTCAGCTAAGATGCCTAATGCATCATTCTCCACTCTGAAGATCCAG
 181  ----------!----------!----------!----------!----------!----------!  240
      GGGCTCCTAGCTAAGAGTCGATTCTACGGATTACGTAGTAAGAGGTGAGACTTCTAGGTC

1:    P  S  E  P  R  D  S  A  V  Y  F  C  A  S  S  V  A  Q  L  A
      CCCTCAGAACCCAGGGACTCAGCTGTGTACTTCTGTGCCAGCAGTGTGGCCCAACTAGCG
 241  ----------!----------!----------!----------!----------!----------!  300
      GGGAGTCTTGGGTCCCTGAGTCGACACATGAAGACACGGTCGTCACACCGGGTTGATCGC

1:    G  K  G  E  Q  F  F  G  P  G  T  R  L  T  V  L  E  D  L  K
      GGAAAGGGTGAGCAGTTCTTCGGGCCAGGGACACGGCTCACCGTGCTAGAGGACCTGAAA
 301  ----------!----------!----------!----------!----------!----------!  360
      CCTTTCCCACTCGTCAAGAAGCCCGGTCCCTGTGCCGAGTGGCACGATCTCCTGGACTTT

1:    N  V  F  P  P  E  V  A  V  F  E  P  S (SEQ ID NO: 736)
      AACGTGTTCCCACCCGAGGTCGCTGTGTTTGAGCCATCAGA (SEQ ID NO: 735)
 361  ----------!----------!----------!----------!- 401
      TTGCACAAGGGTGGGCTCCAGCGACACAAACTCGGTAGTCT (SEQ ID NO: 1558)
```

Figure 40a. SEQ33

TCR22: hTRBV2-CDR3 (ASRRVMGYGYT) (SEQ ID NO: 138)

GAA CCT GAA GTC ACC CAG ACT CCC AGC CAT CAG GTC ACA CAG ATG GGA CAG (SEQ ID NO: 1559)
gaagtgatcttgcgctgtgtcccatctctaatcacttatacttctattggtacagacaaatcttggggcagaaagtcgagtttctggtttcctttatAAT
AATGAAATCTCAGAGAAGTCTGAAATATTCGATGATCAATTCTCAGTTGAAAGGCCTGATGGATCAAATTTCACTC
TGAAGATCCGGTCCACAAAGCTGGAGGACTCAGCCATGTACTTCTGTGCCAGCAGAAGGGTAatgggctatggctacac
cttcggttcggggaccaggttaaccgttgtagaggacctgaacaaggtgttcccacccgaggtcgctgtgtttgagccatcaga(SEQ ID NO: 1560)

```
    1: E  P  E  V  T  Q  T  P  S  H  Q  V  T  Q  M  G  Q  E  V  I
       GAACCTGAAGTCACCCAGACTCCCAGCCATCAGGTCACACAGATGGGACAGGAAGTGATC
    1  ----------|----------|----------|----------|----------|----------| 60
       CTTGGACTTCAGTGGGTCTGAGGGTCGGTAGTCCAGTGTGTCTACCCTGTCCTTCACTAG

1: L  R  C  V  P  I  S  N  H  L  Y  F  Y  W  Y  R  Q  I  L  G
       TTGCGCTGTGTCCCCATCTCTAATCACTTATACTTCTATTGGTACAGACAAATCTTGGGG
   61  ----------|----------|----------|----------|----------|----------| 120
       AACGCGACACAGGGGTAGAGATTAGTGAATATGAAGATAACCATGTCTGTTTAGAACCCC

1: Q  K  V  E  F  L  V  S  F  Y  N  N  E  I  S  E  K  S  E  I
       CAGAAAGTCGAGTTTCTGGTTTCCTTTTATAATAATGAAATCTCAGAGAAGTCTGAAATA
   121 ----------|----------|----------|----------|----------|----------| 180
       GTCTTTCAGCTCAAAGACCAAAGGAAAATATTATTACTTTAGAGTCTCTTCAGACTTTAT

1: F  D  D  Q  F  S  V  E  R  P  D  G  S  N  F  T  L  K  I  R
       TTCGATGATCAATTCTCAGTTGAAAGGCCTGATGGATCAAATTTCACTCTGAAGATCCGG
   181 ----------|----------|----------|----------|----------|----------| 240
       AAGCTACTAGTTAAGAGTCAACTTTCCGGACTACCTAGTTTAAAGTGAGACTTCTAGGCC

1: S  T  K  L  E  D  S  A  M  Y  F  C  A  S  R  R  V  M  G  Y
       TCCACAAAGCTGGAGGACTCAGCCATGTACTTCTGTGCCAGCAGAAGGGTAATGGGCTAT
   241 ----------|----------|----------|----------|----------|----------| 300
       AGGTGTTTCGACCTCCTGAGTCGGTACATGAAGACACGGTCGTCTTCCCATTACCCGATA

1: G  Y  T  F  G  S  G  T  R  L  T  V  V  E  D  L  N  K  V  F
       GGCTACACCTTCGGTTCGGGGACCAGGTTAACCGTTGTAGAGGACCTGAACAAGGTGTTC
   301 ----------|----------|----------|----------|----------|----------| 360
       CCGATGTGGAAGCCAAGCCCCTGGTCCAATTGGCAACATCTCCTGGACTTGTTCCACAAG

1: P  P  E  V  A  V  F  E  P  S (SEQ ID NO: 736)
       CCACCCGAGGTCGCTGTGTTTGAGCCATCAGA (SEQ ID NO: 737)
   361 ----------|----------|---------- 392
       GGTGGGCTCCAGCGACACAAACTCGGTAGTCT (SEQ ID NO: 1561)
```

Figure 40b. SEQ34

TCR22 hTRAV21-CDR3 (ALNSGGSNYKLT) (SEQ ID NO: 141)

AAA CAG GAG GTG ACG CAG ATT CCT GCA GCT CTG AGT GTC CCA GAA GGA GAA AAC (SEQ ID NO: 1562)
ttggttctcaactgcagtttcactgatagcgctatttacaacctccagtggtttaggcaggaccctgggaaaggtctcacatctctgTTGCTTATTCA
GTCAAGTCAGAGAGAGCAAACAAGTGGAAGACTTAATGCCTCGCTGGATAAATCATCAGGACGTAGTACTTTATA
CATTGCAGCTTCTCAGCCTGGTGACTCAGCCACCTACCTCTGTGCTCTGAATAGTGGAGGTAGCAACTataaactgaca
tttggaaaaggaactctcttaaccgtgaatccaaatatccagaaccctgaccctgccgtgtaccagctgagagact (SEQ ID NO: 1563)

```
      1: K  Q  E  V  T  Q  I  P  A  A  L  S  V  P  E  G  E  N  L  V
         AAACAGGAGGTGACGCAGATTCCTGCAGCTCTGAGTGTCCCAGAAGGAGAAAACTTGGTT
      1  ----------|----------|----------|----------|----------|----------| 60
         TTTGTCCTCCACTGCGTCTAAGGACGTCGAGACTCACAGGGTCTTCCTCTTTTGAACCAA

1: L  N  C  S  F  T  D  S  A  I  Y  N  L  Q  W  F  R  Q  D  P
         CTCAACTGCAGTTTCACTGATAGCGCTATTTACAACCTCCAGTGGTTTAGGCAGGACCCT
     61  ----------|----------|----------|----------|----------|----------| 120
         GAGTTGACGTCAAAGTGACTATCGCGATAAATGTTGGAGGTCACCAAATCCGTCCTGGGA

1: G  K  G  L  T  S  L  L  L  I  Q  S  S  Q  R  E  Q  T  S  G
         GGGAAAGGTCTCACATCTCTGTTGCTTATTCAGTCAAGTCAGAGAGAGCAAACAAGTGGA
    121  ----------|----------|----------|----------|----------|----------| 180
         CCCTTTCCAGAGTGTAGAGACAACGAATAAGTCAGTTCAGTCTCTCGTTTGTTCACCT

1: R  L  N  A  S  L  D  K  S  S  G  R  S  T  L  Y  I  A  A  S
         AGACTTAATGCCTCGCTGGATAAATCATCAGGACGTAGTACTTTATACATTGCAGCTTCT
    181  ----------|----------|----------|----------|----------|----------| 240
         TCTGAATTACGGAGCGACCTATTTAGTAGTCCTGCATCATGAAATATGTAACGTCGAAGA

1: Q  P  G  D  S  A  T  Y  L  C  A  L  N  S  G  G  S  N  Y  K
         CAGCCTGGTGACTCAGCCACCTACCTCTGTGCTCTGAATAGTGGAGGTAGCAACTATAAA
    241  ----------|----------|----------|----------|----------|----------| 300
         GTCGGACCACTGAGTCGGTGGATGGAGACACGAGACTTATCACCTCCATCGTTGATATTT

1: L  T  F  G  K  G  T  L  L  T  V  N  P  N  I  Q  N  P  D  P
         CTGACATTTGGAAAAGGAACTCTCTTAACCGTGAATCCAAATATCCAGAACCCTGACCCT
    301  ----------|----------|----------|----------|----------|----------| 360
         GACTGTAAACCTTTTCCTTGAGAGAATTGGCACTTAGGTTTATAGGTCTTGGGACTGGGA

1: A  V  Y  Q  L  R  D  (SEQ ID NO: 740)
         GCCGTGTACCAGCTGAGAGACT (SEQ ID NO: 739)
    361  ----------|----------|-- 382
         CGGCACATGGTCGACTCTCTGA (SEQ ID NO: 1564)
```

Figure 41a. SEQ35

TCR 23: hTRBV20-1-CDR3 (SAGRAGTSGTYEQY) (SEQ ID NO: 142)

```
GGT GCT GTC GTC TCT CAA CAT CCG AGC TGG GTT ATC TGT AAG AGT GGA (SEQ ID NO: 1565)
acctctgtgaagatcgagtgccgttccctggactttcaggccacaactatgttttggtatcgtcagttcccgaaacagagtctcatgctgatggcaacttc
caatgagggctccaaggCCACATACGAGCAAGGCGTCGAGAAGGACAAGTTTCTCATCAACCATGCAAGCCTGACCTTG
TCCACTCTGACAGTGACCAGTGCCCATCCTGAAGACAGCAGCTTCTACATCtgcagtgccggccgggcggggactagcggaac
atacgagcagtacttcgggccgggcaccaggctcacggtcacagaggacctgaaaaacgtgttcccacccgaggtcgctgtgtttgagccatcaga
                                                                              (SEQ ID NO: 1566)
```

```
  1: G   A   V   V   S   Q   H   P   S   W   V   I   C   K   S   G   T   S   V   K
     GGTGCTGTCGTCTCTCAACATCCGAGCTGGGTTATCTGTAAGAGTGGAACCTCTGTGAAG
  1  ----------|----------|----------|----------|----------|----------| 60
     CCACGACAGCAGAGAGTTGTAGGCTCGACCCAATAGACATTCTCACCTTGGAGACACTTC

1: I   E   C   R   S   L   D   F   Q   A   T   T   M   F   W   Y   R   Q   F   P
     ATCGAGTGCCGTTCCCTGGACTTTCAGGCCACAACTATGTTTTGGTATCGTCAGTTCCCG
 61  ----------|----------|----------|----------|----------|----------| 120
     TAGCTCACGGCAAGGGACCTGAAAGTCCGGTGTTGATACAAAACCATAGCAGTCAAGGGC

1: K   Q   S   L   M   L   M   A   T   S   N   E   G   S   K   A   T   Y   E   Q
     AAACAGAGTCTCATGCTGATGGCAACTTCCAATGAGGGCTCCAAGGCCACATACGAGCAA
 121 ----------|----------|----------|----------|----------|----------| 180
     TTTGTCTCAGAGTACGACTACCGTTGAAGGTTACTCCCGAGGTTCCGGTGTATGCTCGTT

1: G   V   E   K   D   K   F   L   I   N   H   A   S   L   T   L   S   T   L   T
     GGCGTCGAGAAGGACAAGTTTCTCATCAACCATGCAAGCCTGACCTTGTCCACTCTGACA
 181 ----------|----------|----------|----------|----------|----------| 240
     CCGCAGCTCTTCCTGTTCAAAGAGTAGTTGGTACGTTCGGACTGGAACAGGTGAGACTGT

1: V   T   S   A   H   P   E   D   S   S   F   Y   I   C   S   A   G   R   A   G
     GTGACCAGTGCCCATCCTGAAGACAGCAGCTTCTACATCTGCAGTGCCGGCCGGGCGGGG
 241 ----------|----------|----------|----------|----------|----------| 300
     CACTGGTCACGGGTAGGACTTCTGTCGTCGAAGATGTAGACGTCACGGCCGGCCCGCCCC

1: T   S   G   T   Y   E   Q   Y   F   G   P   G   T   R   L   T   V   T   E   D
     ACTAGCGGAACATACGAGCAGTACTTCGGGCCGGGCACCAGGCTCACGGTCACAGAGGAC
 301 ----------|----------|----------|----------|----------|----------| 360
     TGATCGCCTTGTATGCTCGTCATGAAGCCCGGCCCGTGGTCCGAGTGCCAGTGTCTCCTG

1: L   K   N   V   F   P   P   E   V   A   V   F   E   P   S (SEQ ID NO: 1567)
     CTGAAAAACGTGTTCCCACCCGAGGTCGCTGTGTTTGAGCCATCAGA (SEQ ID NO: 741)
 361 ----------|----------|----------|----------|-------- 407
     GACTTTTTGCACAAGGGTGGGCTCCAGCGACACAAACTCGGTAGTCT (SEQ ID NO: 1568)
```

Figure 41b. SEQ36

TCR23: hTRAV26-2-CDR3 (ILRSNFGNEKLT) (SEQ ID NO: 143)

GAT GCT AAG ACC ACA CAG CCA AAT TCA ATG GAG AGT AAC GAA GAA GAG (SEQ ID NO: 1553)
CctgttcacttgccttgtaaccactccacaatcagtggaactgattacatacattggtatcgacagcttccctcccagggtccagaGTACGTGATTC
ATGGTCTTACAAGCAATGTGAACAACAGAATGGCCTCTCTGGCAATCGCTGAAGACAGAAAGTCCAGTACCTTGAT
CCTGCACCGTGCTACCTTGAGAGATGCTGCTGTGTACTACTGCATCCTGAGATCTAACTTTGGAAATGagaaattaacc
tttgggactggaacaagactcaccatcatacccaatatccagaacCCtgaccctgccgtgtaccagctgagagact (SEQ ID NO: 1569)

```
1: D  A  K  T  T  Q  P  N  S  M  E  S  N  E  E  E  P  V  H  L
      GATGCTAAGACCACACAGCCAAATTCAATGGAGAGTAACGAAGAAGAGCCTGTTCACTTG
   1  ---------!---------!---------!---------!---------!---------! 60
      CTACGATTCTGGTGTGTCGGTTTAAGTTACCTCTCATTGCTTCTTCTCGGACAAGTGAAC

1: P  C  N  H  S  T  I  S  G  T  D  Y  I  H  W  Y  R  Q  L  P
      CCTTGTAACCACTCCACAATCAGTGGAACTGATTACATACATTGGTATCGACAGCTTCCC
  61  ---------!---------!---------!---------!---------!---------! 120
      GGAACATTGGTGAGGTGTTAGTCACCTTGACTAATGTATGTAACCATAGCTGTCGAAGGG

1: S  Q  G  P  E  Y  V  I  H  G  L  T  S  N  V  N  N  R  M  A
      TCCCAGGGTCCAGAGTACGTGATTCATGGTCTTACAAGCAATGTGAACAACAGAATGGCC
 121  ---------!---------!---------!---------!---------!---------! 180
      AGGGTCCCAGGTCTCATGCACTAAGTACCAGAATGTTCGTTACACTTGTTGTCTTACCGG

1: S  L  A  I  A  E  D  R  K  S  S  T  L  I  L  H  R  A  T  L
      TCTCTGGCAATCGCTGAAGACAGAAAGTCCAGTACCTTGATCCTGCACCGTGCTACCTTG
 181  ---------!---------!---------!---------!---------!---------! 240
      AGAGACCGTTAGCGACTTCTGTCTTTCAGGTCATGGAACTAGGACGTGGCACGATGGAAC

1: R  D  A  A  V  Y  Y  C  I  L  R  S  N  F  G  N  E  K  L  T
      AGAGATGCTGCTGTGTACTACTGCATCCTGAGATCTAACTTTGGAAATGAGAAATTAACC
 241  ---------!---------!---------!---------!---------!---------! 300
      TCTCTACGACGACACATGATGACGTAGGACTCTAGATTGAAACCTTTACTCTTTAATTGG

1: F  G  T  G  T  R  L  T  I  I  P  N  I  Q  N  P  D  P  A  V
      TTTGGGACTGGAACAAGACTCACCATCATACCCAATATCCAGAACCCTGACCCTGCCGTG
 301  ---------!---------!---------!---------!---------!---------! 360
      AAACCCTGACCTTGTTCTGAGTGGTAGTATGGGTTATAGGTCTTGGGACTGGGACGGCAC

1: Y  Q  L  R  D (SEQ ID NO: 744)
      TACCAGCTGAGAGACT (SEQ ID NO: 743)
 361  ---------!------ 376
      ATGGTCGACTCTCTGA (SEQ ID NO: 1570)
```

Figure 42a. SEQ37

TCR24: hTRBV19-CDR3 (ASSGGQFNQPQH) (SEQ ID NO: 144)

GAT GGT GGA ATC ACT CAG TCC CCA AAG TAC CTG TTC AGA AAG GAA GGA CAG AAT (SEQ ID NO: 1519)
GtgaccctgagttgtgaacagaatttgaaccacgatgccatgtactggtaccgacaggacccagggcaagggctgagattgatctactactcacagA
TAGTAAATGACTTTCAGAAAGGAGATATAGCTGAAGGGTACAGCGTCTCTCGGGAGAAGAAGGAATCCTTTCCTC
TCACTGTGACATCGGCCCAAAAGAACCCGACAGCTTTCTATCTCTGTGCCAGTAGTGGGGGACAGTTCAatcagcccc
agcatttggtgatgggactcgactctccatcctagaggacctgaacaaggtgttcccacccgaggtcgctgtgtttgagccatcaga
(SEQ ID NO: 1571)

```
      1: D  G  G  I  T  Q  S  P  K  Y  L  F  R  K  E  G  Q  N  V  T
         GATGGTGGAATCACTCAGTCCCCAAAGTACCTGTTCAGAAAGGAAGGACAGAATGTGACC
      1  ----------!----------!----------!----------!----------!----------! 60
         CTACCACCTTAGTGAGTCAGGGGTTTCATGGACAAGTCTTTCCTTCCTGTCTTACACTGG

1: L  S  C  E  Q  N  L  N  H  D  A  M  Y  W  Y  R  Q  D  P  G
         CTGAGTTGTGAACAGAATTTGAACCACGATGCCATGTACTGGTACCGACAGGACCCAGGG
     61  ----------!----------!----------!----------!----------!----------! 120
         GACTCAACACTTGTCTTAAACTTGGTGCTACGGTACATGACCATGGCTGTCCTGGGTCCC

1: Q  G  L  R  L  I  Y  Y  S  Q  I  V  N  D  F  Q  K  G  D  I
         CAAGGGCTGAGATTGATCTACTACTCACAGATAGTAAATGACTTTCAGAAAGGAGATATA
    121  ----------!----------!----------!----------!----------!----------! 180
         GTTCCCGACTCTAACTAGATGATGAGTGTCTATCATTTACTGAAAGTCTTTCCTCTATAT

1: A  E  G  Y  S  V  S  R  E  K  K  E  S  F  P  L  T  V  T  S
         GCTGAAGGGTACAGCGTCTCTCGGGAGAAGAAGGAATCCTTTCCTCTCACTGTGACATCG
    181  ----------!----------!----------!----------!----------!----------! 240
         CGACTTCCCATGTCGCAGAGAGCCCTCTTCTTCCTTAGGAAAGGAGAGTGACACTGTAGC

1: A  Q  K  N  P  T  A  F  Y  L  C  A  S  S  G  G  Q  F  N  Q
         GCCCAAAAGAACCCGACAGCTTTCTATCTCTGTGCCAGTAGTGGGGGACAGTTCAATCAG
    241  ----------!----------!----------!----------!----------!----------! 300
         CGGGTTTTCTTGGGCTGTCGAAAGATAGAGACACGGTCATCACCCCCTGTCAAGTTAGTC

1: P  Q  H  F  G  D  G  T  R  L  S  I  L  E  D  L  N  K  V  F
         CCCCAGCATTTTGGTGATGGGACTCGACTCTCCATCCTAGAGGACCTGAACAAGGTGTTC
    301  ----------!----------!----------!----------!----------!----------! 360
         GGGGTCGTAAAACCACTACCCTGAGCTGAGAGGTAGGATCTCCTGGACTTGTTCCACAAG

1: P  P  E  V  A  V  F  E  P  S  (SEQ ID NO: 746)
         CCACCCGAGGTCGCTGTGTTTGAGCCATCAGA (SEQ ID NO: 745)
    361  ----------!----------!----------!-- 392
         GGTGGGCTCCAGCGACACAAACTCGGTAGTCT (SEQ ID NO: 1572)
```

Figure 42b. SEQ38

TCR24: hTRAV6-CDR3 (ALGQTGANNLF) (SEQ ID NO: 147)

AGC CAA AAG ATA GAA CAG AAT TCC GAG GCC CTG AAC ATT CAG GAG GGT AAA (SEQ ID NO: 1573)
AcggccaccctgacctgcaactatacaaactattctccagcatacttacagtggtaccgacaagatccaggaagaggccctgttttcTTGCTACTT
ATACGTGAAAATGAGAAAGAAAAAAGGAAAGAAAGACTGAAGGTCACCTTTGATACCACCCTTAAACAGAGTTTG
TTTCATATCACAGCCTCCCAGCCTGCAGACTCAGCTACCTACCTCTGTGCTCTAGGGCAAACTGGGGCaaacaacctct
tctttgggactggaacgagactcaccgttattccctatatccagaaccctgaccctgccgtgtaccagctgagagact (SEQ ID NO: 1574)

```
    1: S  Q  K  I  E  Q  N  S  E  A  L  N  I  Q  E  G  K  T  A  T
       AGCCAAAAGATAGAACAGAATTCCGAGGCCCTGAACATTCAGGAGGGTAAAACGGCCACC
    1  ----------!----------!----------!----------!----------!----------! 60
       TCGGTTTTCTATCTTGTCTTAAGGCTCCGGGACTTGTAAGTCCTCCCATTTTGCCGGTGG

1: L  T  C  N  Y  T  N  Y  S  P  A  Y  L  Q  W  Y  R  Q  D  P
       CTGACCTGCAACTATACAAACTATTCTCCAGCATACTTACAGTGGTACCGACAAGATCCA
   61  ----------!----------!----------!----------!----------!----------! 120
       GACTGGACGTTGATATGTTTGATAAGAGGTCGTATGAATGTCACCATGGCTGTTCTAGGT

1: G  R  G  P  V  F  L  L  L  I  R  E  N  E  K  E  K  R  K  E
       GGAAGAGGCCCTGTTTTCTTGCTACTTATACGTGAAAATGAGAAAGAAAAAAGGAAAGAA
  121  ----------!----------!----------!----------!----------!----------! 180
       CCTTCTCCGGGACAAAAGAACGATGAATATGCACTTTTACTCTTTCTTTTTCCTTTCTT

1: R  L  K  V  T  F  D  T  T  L  K  Q  S  L  F  H  I  T  A  S
       AGACTGAAGGTCACCTTTGATACCACCCTTAAACAGAGTTTGTTTCATATCACAGCCTCC
  181  ----------!----------!----------!----------!----------!----------! 240
       TCTGACTTCCAGTGGAAACTATGGTGGGAATTTGTCTCAAACAAAGTATAGTGTCGGAGG

1: Q  P  A  D  S  A  T  Y  L  C  A  L  G  Q  T  G  A  N  N  L
       CAGCCTGCAGACTCAGCTACCTACCTCTGTGCTCTAGGGCAAACTGGGGCAAACAACCTC
  241  ----------!----------!----------!----------!----------!----------! 300
       GTCGGACGTCTGAGTCGATGGATGGAGACACGAGATCCCGTTTGACCCCGTTTGTTGGAG

1: F  F  G  T  G  T  R  L  T  V  I  P  Y  I  Q  N  P  D  P  A
       TTCTTTGGGACTGGAACGAGACTCACCGTTATTCCCTATATCCAGAACCCTGACCCTGCC
  301  ----------!----------!----------!----------!----------!----------! 360
       AAGAAACCCTGACCTTGCTCTGAGTGGCAATAAGGGATATAGGTCTTGGGACTGGGACGG

1: V  Y  Q  L  R  D  (SEQ ID NO: 748)
       GTGTACCAGCTGAGAGACT (SEQ ID NO: 747)
  361  ----------!--------- 379
       CACATGGTCGACTCTCTGA (SEQ ID NO: 1575)
```

Figure 43a. SEQ39

TCR25 : hTRBV18-CDR3 (ASSPEALANTGELF) (SEQ ID NO: 150)

AAT GCC GGC GTC ATG CAG AAC CCA AGA CAC CTG GTC AGG AGG AGG GGA CAG GAG (SEQ ID NO: 1576)
gcaagactgagatgcagcccaatgaaaggacacagtcatgtttactggtatcggcagctcccagaggaaggtctgaaattcatggtttatctccagaa
agaaaatATCATAGATGAGTCAGGAATGCCAAAGGAACGATTTTCTGCTGAATTTCCCAAAGAGGGCCCCAGCATCC
TGAGGATCCAGCAGGTAGTGCGAGGAGATTCGGCAGCTTATTTCTGTGCCAGCTCACCCGAGGCTCtggcgaacaccg
gggagctgttttttggagaaggctctaggctgaccgtactggaggacctgaaaaacgtgttcccacccgaggtcgctgtgtttgagccatcaga
(SEQ ID NO: 1577)

```
    1: N   A   G   V   M   Q   N   P   R   H   L   V   R   R   R   G   Q   E   A   R
       AATGCCGGCGTCATGCAGAACCCAAGACACCTGGTCAGGAGGAGGGGACAGGAGGCAAGA
    1  ----------|----------|----------|----------|----------|----------| 60
       TTACGGCCGCAGTACGTCTTGGGTTCTGTGGACCAGTCCTCCTCCCCTGTCCTCCGTTCT

1: L   R   C   S   P   M   K   G   H   S   H   V   Y   W   Y   R   Q   L   P   E
       CTGAGATGCAGCCCAATGAAAGGACACAGTCATGTTTACTGGTATCGGCAGCTCCCAGAG
    61 ----------|----------|----------|----------|----------|----------| 120
       GACTCTACGTCGGGTTACTTTCCTGTGTCAGTACAAATGACCATAGCCGTCGAGGGTCTC

1: E   G   L   K   F   M   V   Y   L   Q   K   E   N   I   I   D   E   S   G   M
       GAAGGTCTGAAATTCATGGTTTATCTCCAGAAAGAAAATATCATAGATGAGTCAGGAATG
   121 ----------|----------|----------|----------|----------|----------| 180
       CTTCCAGACTTTAAGTACCAAATAGAGGTCTTTCTTTTATAGTATCTACTCAGTCCTTAC

1: P   K   E   R   F   S   A   E   F   P   K   E   G   P   S   I   L   R   I   Q
       CCAAAGGAACGATTTTCTGCTGAATTTCCCAAAGAGGGCCCCAGCATCCTGAGGATCCAG
   181 ----------|----------|----------|----------|----------|----------| 240
       GGTTTCCTTGCTAAAAGACGACTTAAAGGGTTTCTCCCGGGGTCGTAGGACTCCTAGGTC

1: Q   V   V   R   G   D   S   A   A   Y   F   C   A   S   S   P   E   A   L   A
       CAGGTAGTGCGAGGAGATTCGGCAGCTTATTTCTGTGCCAGCTCACCCGAGGCTCTGGCG
   241 ----------|----------|----------|----------|----------|----------| 300
       GTCCATCACGCTCCTCTAAGCCGTCGAATAAAGACACGGTCGAGTGGGCTCCGAGACCGC

1: N   T   G   E   L   F   F   G   E   G   S   R   L   T   V   L   E   D   L   K
       AACACCGGGGAGCTGTTTTTTGGAGAAGGCTCTAGGCTGACCGTACTGGAGGACCTGAAA
   301 ----------|----------|----------|----------|----------|----------| 360
       TTGTGGCCCCTCGACAAAAAACCTCTTCCGAGATCCGACTGGCATGACCTCCTGGACTTT

1: N   V   F   P   P   E   V   A   V   F   E   P   S (SEQ ID NO: 750)
       AACGTGTTCCCACCCGAGGTCGCTGTGTTTGAGCCATCAGA (SEQ ID NO: 749)
   361 ----------|----------|----------|----------|- 401
       TTGCACAAGGGTGGGCTCCAGCGACACAAACTCGGTAGTCT (SEQ ID NO: 1578)
```

Figure 43 b. SEQ40

TCR25: hTRAV26-1-CDR3 (IVRVGYNNNDMR) (SEQ ID NO: 153)
(SEQ ID NO: 1579)
GAT GCT AAG ACC ACC CAG ... CCC CCC TCC ATG GAT TGC GCT GAA GGA AGA (SEQ ID NO: 1580)
gctgcaaacctgccttgtaatcactctaccatcagtggaaatgagtatgtgtattggtatcgacagattcactcccaggggccacaGTATATCATTC
ATGGTCTAAAAAACAATGAAACCAATGAAATGGCCTCTCTGATCATCACAGAAGACAGAAAGTCCAGCACCTTGAT
CCTGCCCCACGCTACGCTGAGAGACACTGCTGTGTACTATTGCATCGTCAGAGTGGGGTAcaataacaatgacatgcgct
tggagcagggaccagactgacagtaaaaccaaatatccagaaccctgaccctgccgtgtaccagctgagagact (SEQ ID NO: 1581)

```
      1: D  A  K  T  T  Q  P  P  S  M  D  C  A  E  G  R  A  A  N  L
         GATGCTAAGACCACCCAGCCCCCCTCCATGGATTGCGCTGAAGGAAGAGCTGCAAACCTG
      1 ----------|----------|----------|----------|----------|----------| 60
         CTACGATTCTGGTGGGTCGGGGGGAGGTACCTAACGCGACTTCCTTCTCGACGTTTGGAC

1: P  C  N  H  S  T  I  S  G  N  E  Y  V  Y  W  Y  R  Q  I  H
         CCTTGTAATCACTCTACCATCAGTGGAAATGAGTATGTGTATTGGTATCGACAGATTCAC
     61 ----------|----------|----------|----------|----------|----------| 120
         GGAACATTAGTGAGATGGTAGTCACCTTTACTCATACACATAACCATAGCTGTCTAAGTG

1: S  Q  G  P  Q  Y  I  I  H  G  L  K  N  N  E  T  N  E  M  A
         TCCCAGGGGCCACAGTATATCATTCATGGTCTAAAAAACAATGAAACCAATGAAATGGCC
    121 ----------|----------|----------|----------|----------|----------| 180
         AGGGTCCCCGGTGTCATATAGTAAGTACCAGATTTTTTGTTACTTTGGTTACTTTACCGG

1: S  L  I  I  T  E  D  R  K  S  S  T  L  I  L  P  H  A  T  L
         TCTCTGATCATCACAGAAGACAGAAAGTCCAGCACCTTGATCCTGCCCCACGCTACGCTG
    181 ----------|----------|----------|----------|----------|----------| 240
         AGAGACTAGTAGTGTCTTCTGTCTTTCAGGTCGTGGAACTAGGACGGGGTGCGATGCGAC

1: R  D  T  A  V  Y  Y  C  I  V  R  V  G  Y  N  N  N  D  M  R
         AGAGACACTGCTGTGTACTATTGCATCGTCAGAGTGGGGTACAATAACAATGACATGCGC
    241 ----------|----------|----------|----------|----------|----------| 300
         TCTCTGTGACGACACATGATAACGTAGCAGTCTCACCCCATGTTATTGTTACTGTACGCG

1: F  G  A  G  T  R  L  T  V  K  P  N  I  Q  N  P  D  P  A  V
         TTTGGAGCAGGGACCAGACTGACAGTAAAACCAAATATCCAGAACCCTGACCCTGCCGTG
    301 ----------|----------|----------|----------|----------|----------| 360
         AAACCTCGTCCCTGGTCTGACTGTCATTTTGGTTTATAGGTCTTGGGACTGGGACGGCAC

1: Y  Q  L  R  D (SEQ ID NO: 752)
         TACCAGCTGAGAGACT (SEQ ID NO: 751)
    361 ----------|------ 376
         ATGGTCGACTCTCTGA (SEQ ID NO: 1582)
```

Figure 44a. SEQ41

TCR26: hTRBV24-1-CDR3 (ATSDPSGPPYEQY) (SEQ ID NO: 156)

GAT GCT GAT GTT ACC CAG ACC CCA AGG AAT AGG ATC ACA AAG ACA GGA AAG AGG (SEQ ID NO: 1583)
attatgctggaatgttctcagactaagggtcatgatagaatgtactggtatcgacaagacccaggactgggcctacggttgatctattactcctttgatG
TCAAAGATATAAACAAAGGAGAGATCTCTGATGGATACAGTGTCTCTCGACAGGCACAGGCTAAATTCTCCCTGTC
CCTAGAGTCTGCCATCCCCAACCAGACAGCTCTTTACTTCTGTGCCACCAGTGACCCTAGCGGGcccccctacgagcagt
acttcgggccgggcaccaggctcacggtcacagaggacctgaaaaacgtgttcccacccgaggtcgctgtgtttgagccatcaga
(SEQ ID NO: 1584)

```
   1: D  A  D  V  T  Q  T  P  R  N  R  I  T  K  T  G  K  R  I  M
      GATGCTGATGTTACCCAGACCCCAAGGAATAGGATCACAAAGACAGGAAAGAGGATTATG
   1  ----------|----------|----------|----------|----------|----------| 60
      CTACGACTACAATGGGTCTGGGGTTCCTTATCCTAGTGTTTCTGTCCTTTCTCCTAATAC

1: L  E  C  S  Q  T  K  G  H  D  R  M  Y  W  Y  R  Q  D  P  G
      CTGGAATGTTCTCAGACTAAGGGTCATGATAGAATGTACTGGTATCGACAAGACCCAGGA
  61  ----------|----------|----------|----------|----------|----------| 120
      GACCTTACAAGAGTCTGATTCCCAGTACTATCTTACATGACCATAGCTGTTCTGGGTCCT

1: L  G  L  R  L  I  Y  Y  S  F  D  V  K  D  I  N  K  G  E  I
      CTGGGCCTACGGTTGATCTATTACTCCTTTGATGTCAAAGATATAAACAAAGGAGAGATC
 121  ----------|----------|----------|----------|----------|----------| 180
      GACCCGGATGCCAACTAGATAATGAGGAAACTACAGTTTCTATATTTGTTTCCTCTCTAG

1: S  D  G  Y  S  V  S  R  Q  A  Q  A  K  F  S  L  S  L  E  S
      TCTGATGGATACAGTGTCTCTCGACAGGCACAGGCTAAATTCTCCCTGTCCCTAGAGTCT
 181  ----------|----------|----------|----------|----------|----------| 240
      AGACTACCTATGTCACAGAGAGCTGTCCGTGTCCGATTTAAGAGGGACAGGGATCTCAGA

1: A  I  P  N  Q  T  A  L  Y  F  C  A  T  S  D  P  S  G  P  P
      GCCATCCCCAACCAGACAGCTCTTTACTTCTGTGCCACCAGTGACCCTAGCGGGCCCCCC
 241  ----------|----------|----------|----------|----------|----------| 300
      CGGTAGGGGTTGGTCTGTCGAGAAATGAAGACACGGTGGTCACTGGGATCGCCCGGGGGG

1: Y  E  Q  Y  F  G  P  G  T  R  L  T  V  T  E  D  L  K  N  V
      TACGAGCAGTACTTCGGGCCGGGCACCAGGCTCACGGTCACAGAGGACCTGAAAAACGTG
 301  ----------|----------|----------|----------|----------|----------| 360
      ATGCTCGTCATGAAGCCCGGCCCGTGGTCCGAGTGCCAGTGTCTCCTGGACTTTTTGCAC

1: F  P  P  E  V  A  V  F  E  P  S  (SEQ ID NO: 754)
      TTCCCACCCGAGGTCGCTGTGTTTGAGCCATCAGA  (SEQ ID NO: 753)
 361  ----------|----------|----------|------  395
      AAGGGTGGGCTCCAGCGACACAAACTCGGTAGTCT  (SEQ ID NO: 1585)
```

Figure 44b. SEQ42

TCR26: hTRAV26-2-CDR3 (ILRAQGGSEKLV) (SEQ ID NO: 157)

GAT GCT AAG ACC ACA CAG CCA AAT TCA ATG GAG AGT AAC GAA GAA GAG CCT (SEQ ID NO: 1504)
gttcacttgccttgtaaccactccacaatcagtggaactgattacatacattggtatcgacagcttccctcccagggtccagaGTACGTGATTCAT
GGTCTTACAAGCAATGTGAACAACAGAATGGCCTCTCTGGCAATCGCTGAAGACAGAAAGTCCAGTACCTTGATCC
TGCACCGTGCTACCTTGAGAGATGCTGCTGTGTACTACTGCATCCTGAGAGCTCAGGGCGGATCTGAAAAgctggtct
ttggaaagggaacgaaactgacagtaaacccatatatccagaaccctgaccctgccgtgtaccagctgagagact (SEQ ID NO: 1586)

```
1:  D   A   K   T   T   Q   P   N   S   M   E   S   N   E   E   P   V   H   L
    GATGCTAAGACCACACAGCCAAATTCAATGGAGAGTAACGAAGAAGAGCCTGTTCACTTG
1   ----------|----------|----------|----------|----------|----------| 60
    CTACGATTCTGGTGTGTCGGTTTAAGTTACCTCTCATTGCTTCTTCTCGGACAAGTGAAC

1:  P   C   N   H   S   T   I   S   G   T   D   Y   I   H   W   Y   R   Q   L   P
    CCTTGTAACCACTCCACAATCAGTGGAACTGATTACATACATTGGTATCGACAGCTTCCC
61  ----------|----------|----------|----------|----------|----------| 120
    GGAACATTGGTGAGGTGTTAGTCACCTTGACTAATGTATGTAACCATAGCTGTCGAAGGG

1:  S   Q   G   P   E   Y   V   I   H   G   L   T   S   N   V   N   N   R   M   A
    TCCCAGGGTCCAGAGTACGTGATTCATGGTCTTACAAGCAATGTGAACAACAGAATGGCC
121 ----------|----------|----------|----------|----------|----------| 180
    AGGGTCCCAGGTCTCATGCACTAAGTACCAGAATGTTCGTTACACTTGTTGTCTTACCGG

1:  S   L   A   I   A   E   D   R   K   S   S   T   L   I   L   H   R   A   T   L
    TCTCTGGCAATCGCTGAAGACAGAAAGTCCAGTACCTTGATCCTGCACCGTGCTACCTTG
181 ----------|----------|----------|----------|----------|----------| 240
    AGAGACCGTTAGCGACTTCTGTCTTTCAGGTCATGGAACTAGGACGTGGCACGATGGAAC

1:  R   D   A   A   V   Y   Y   C   I   L   R   A   Q   G   G   S   E   K   L   V
    AGAGATGCTGCTGTGTACTACTGCATCCTGAGAGCTCAGGGCGGATCTGAAAAGCTGGTC
241 ----------|----------|----------|----------|----------|----------| 300
    TCTCTACGACGACACATGATGACGTAGGACTCTCGAGTCCCGCCTAGACTTTTCGACCAG

1:  F   G   K   G   T   K   L   T   V   N   P   Y   I   Q   N   P   D   P   A   V
    TTTGGAAAGGGAACGAAACTGACAGTAAACCCATATATCCAGAACCCTGACCCTGCCGTG
301 ----------|----------|----------|----------|----------|----------| 360
    AAACCTTTCCCTTGCTTTGACTGTCATTTGGGTATATAGGTCTTGGGACTGGGACGGCAC

1:  Y   Q   L   R   D   (SEQ ID NO: 756)
    TACCAGCTGAGAGACT  (SEQ ID NO: 755)
361 ----------|------- 376
    ATGGTCGACTCTCTGA (SEQ ID NO: 1587)
```

Figure 45 a. SEQ43

TCR 27: hTRBV2-CDR3 (ASRAGTGIGGYT) (SEQ ID NO: 153)

GAA CCT GAA GTC ACC CAG ACT CCC AGC CAT CAG GTC ACA CAG ATG GGA CAG (SEQ ID NO: 1559)
gaagtgatcttgcgctgtgtcccatctctaatcacttatacttctattggtacagacaaatcttggggcagaaagtcgagtttctggtttccttttataat
AATGAAATCTCAGAGAAGTCTGAAATATTCGATGATCAATTCTCAGTTGAAAGGCCTGATGGATCAAATTTCACTC
TGAAGATCCGGTCCACAAAGCTGGAGGACTCAGCCATGTACTTCTGTGCCAGCAGAGCCGGGacagggataggggggct
acaccttcggttcggggaccaggttaaccgttgtagaggacctgaacaaggtgttcccacccgaggtcgctgtgtttgagccatcaga
(SEQ ID NO: 1588)

```
1:  E   P   E   V   T   Q   T   P   S   H   Q   V   T   Q   M   G   Q   E   V   I
    GAACCTGAAGTCACCCAGACTCCCAGCCATCAGGTCACACAGATGGGACAGGAAGTGATC
1   ----------|----------|----------|----------|----------|----------| 60
    CTTGGACTTCAGTGGGTCTGAGGGTCGGTAGTCCAGTGTGTCTACCCTGTCCTTCACTAG

1:  L   R   C   V   P   I   S   N   H   L   Y   F   Y   W   Y   R   Q   I   L   G
    TTGCGCTGTGTCCCCATCTCTAATCACTTATACTTCTATTGGTACAGACAAATCTTGGGG
61  ----------|----------|----------|----------|----------|----------| 120
    AACGCGACACAGGGGTAGAGATTAGTGAATATGAAGATAACCATGTCTGTTTAGAACCCC

1:  Q   K   V   E   F   L   V   S   F   Y   N   N   E   I   S   E   K   S   E   I
    CAGAAAGTCGAGTTTCTGGTTTCCTTTTATAATAATGAAATCTCAGAGAAGTCTGAAATA
121 ----------|----------|----------|----------|----------|----------| 180
    GTCTTTCAGCTCAAAGACCAAAGGAAAATATTATTACTTTAGAGTCTCTTCAGACTTTAT

1:  F   D   D   Q   F   S   V   E   R   P   D   G   S   N   F   T   L   K   I   R
    TTCGATGATCAATTCTCAGTTGAAAGGCCTGATGGATCAAATTTCACTCTGAAGATCCGG
181 ----------|----------|----------|----------|----------|----------| 240
    AAGCTACTAGTTAAGAGTCAACTTTCCGGACTACCTAGTTTAAAGTGAGACTTCTAGGCC

1:  S   T   K   L   E   D   S   A   M   Y   F   C   A   S   R   A   G   T   G   I
    TCCACAAAGCTGGAGGACTCAGCCATGTACTTCTGTGCCAGCAGAGCCGGGACAGGGATA
241 ----------|----------|----------|----------|----------|----------| 300
    AGGTGTTTCGACCTCCTGAGTCGGTACATGAAGACACGGTCGTCTCGGCCCTGTCCCTAT

1:  G   G   Y   T   F   G   S   G   T   R   L   T   V   V   E   D   L   N   K   V
    GGGGGCTACACCTTCGGTTCGGGGACCAGGTTAACCGTTGTAGAGGACCTGAACAAGGTG
301 ----------|----------|----------|----------|----------|----------| 360
    CCCCCGATGTGGAAGCCAAGCCCCTGGTCCAATTGGCAACATCTCCTGGACTTGTTCCAC

1:  F   P   P   E   V   A   V   F   E   P   S   (SEQ ID NO: 758)
    TTCCCACCCGAGGTCGCTGTGTTTGAGCCATCAGA                (SEQ ID NO: 757)
361 ----------|----------|----------|------- 395
    AAGGGTGGGCTCCAGCGACACAAACTCGGTAGTCT                (SEQ ID NO: 1589)
```

Figure 45b. SEQ44

TCR 27: hTRAV21-CDR3 (AVYSGGSNYKLT) (SEQ ID NO: 159)

AAA CAG GAG GTG ACG CAG ATT CCT GCA GCT CTG AGT GTC CCA GAA GGA GAA AAC (SEQ ID NO: 1562)
ttggttctcaactgcagtttcactgatagcgctatttacaacctccagtggtttaggcaggaccctgggaaaggtctcacatctctGTTGCTTATTCA
GTCAAGTCAGAGAGAGCAAACAAGTGGAAGACTTAATGCCTCGCTGGATAAATCATCAGGACGTAGTACTTTATA
CATTGCAGCTTCTCAGCCTGGTGACTCAGCCACCTACCTCTGTGCTGTTTATAGTGGAGGTAGCAACTAtaaactgaca
tttggaaaaggaactctcttaaccgtgaatccaaatatccagaaccctgaccctgccgtgtaccagctgagagact (SEQ ID NO: 1590)

```
    1: K   Q   E   V   T   Q   I   P   A   A   L   S   V   P   E   G   E   N   L   V
       AAACAGGAGGTGACGCAGATTCCTGCAGCTCTGAGTGTCCCAGAAGGAGAAAACTTGGTT
    1  ----------|----------|----------|----------|----------|----------|  60
       TTTGTCCTCCACTGCGTCTAAGGACGTCGAGACTCACAGGGTCTTCCTCTTTTGAACCAA

1: L   N   C   S   F   T   D   S   A   I   Y   N   L   Q   W   F   R   Q   D   P
       CTCAACTGCAGTTTCACTGATAGCGCTATTTACAACCTCCAGTGGTTTAGGCAGGACCCT
   61  ----------|----------|----------|----------|----------|----------| 120
       GAGTTGACGTCAAAGTGACTATCGCGATAAATGTTGGAGGTCACCAAATCCGTCCTGGGA

1: G   K   G   L   T   S   L   L   I   Q   S   S   Q   R   E   Q   T   S   G
       GGGAAAGGTCTCACATCTCTGTTGCTTATTCAGTCAAGTCAGAGAGAGCAAACAAGTGGA
  121  ----------|----------|----------|----------|----------|----------| 180
       CCCTTTCCAGAGTGTAGAGACAACGAATAAGTCAGTTCAGTCTCTCTCGTTTGTTCACCT

1: R   L   N   A   S   L   D   K   S   S   G   R   S   T   L   Y   I   A   A   S
       AGACTTAATGCCTCGCTGGATAAATCATCAGGACGTAGTACTTTATACATTGCAGCTTCT
  181  ----------|----------|----------|----------|----------|----------| 240
       TCTGAATTACGGAGCGACCTATTTAGTAGTCCTGCATCATGAAATATGTAACGTCGAAGA

1: Q   P   G   D   S   A   T   Y   L   C   A   V   Y   S   G   G   S   N   Y   K
       CAGCCTGGTGACTCAGCCACCTACCTCTGTGCTGTTTATAGTGGAGGTAGCAACTATAAA
  241  ----------|----------|----------|----------|----------|----------| 300
       GTCGGACCACTGAGTCGGTGGATGGAGACACGACAAATATCACCTCCATCGTTGATATTT

1: L   T   F   G   K   G   T   L   L   T   V   N   P   N   I   Q   N   P   D   P
       CTGACATTTGGAAAAGGAACTCTCTTAACCGTGAATCCAAATATCCAGAACCCTGACCCT
  301  ----------|----------|----------|----------|----------|----------| 360
       GACTGTAAACCTTTTCCTTGAGAGAATTGGCACTTAGGTTTATAGGTCTTGGGACTGGGA

1: A   V   Y   Q   L   R   D (SEQ ID NO: 760)
       GCCGTGTACCAGCTGAGAGACT (SEQ ID NO: 759)
  361  ----------|----------|-- 382
       CGGCACATGGTCGACTCTCTGA (SEQ ID NO: 1591)
```

Figure 46:
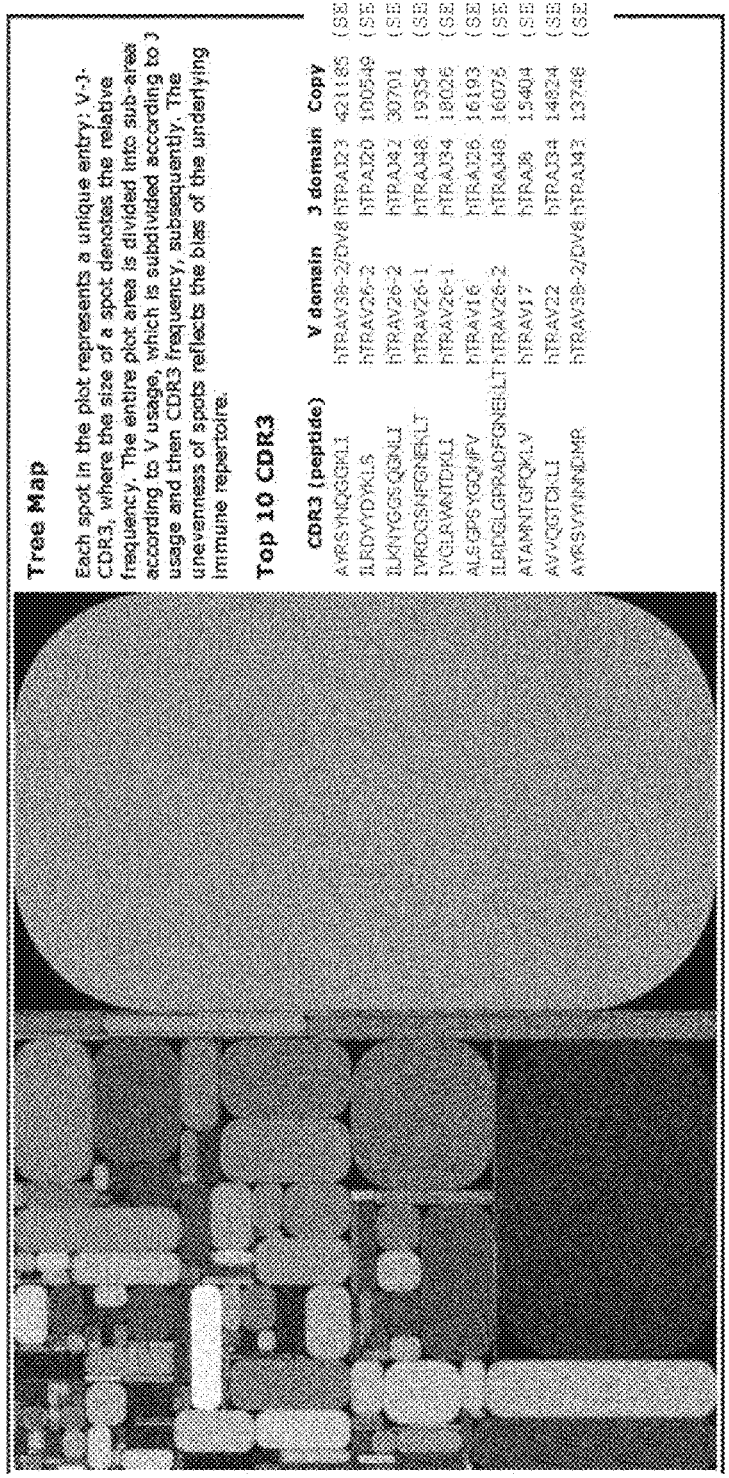

Figure 46 TREE MAP
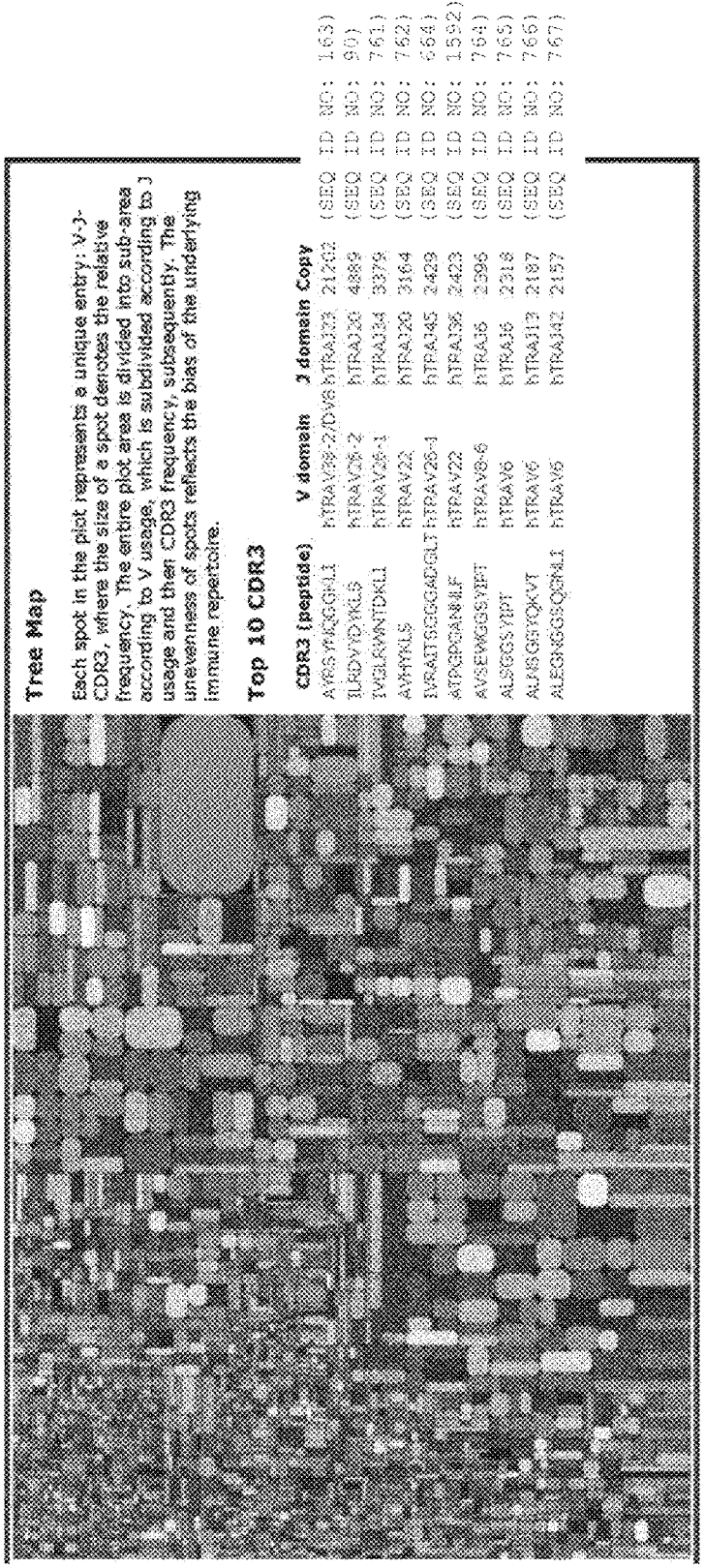
A) TRA CFSE-High

B) TRA CFSE-Low

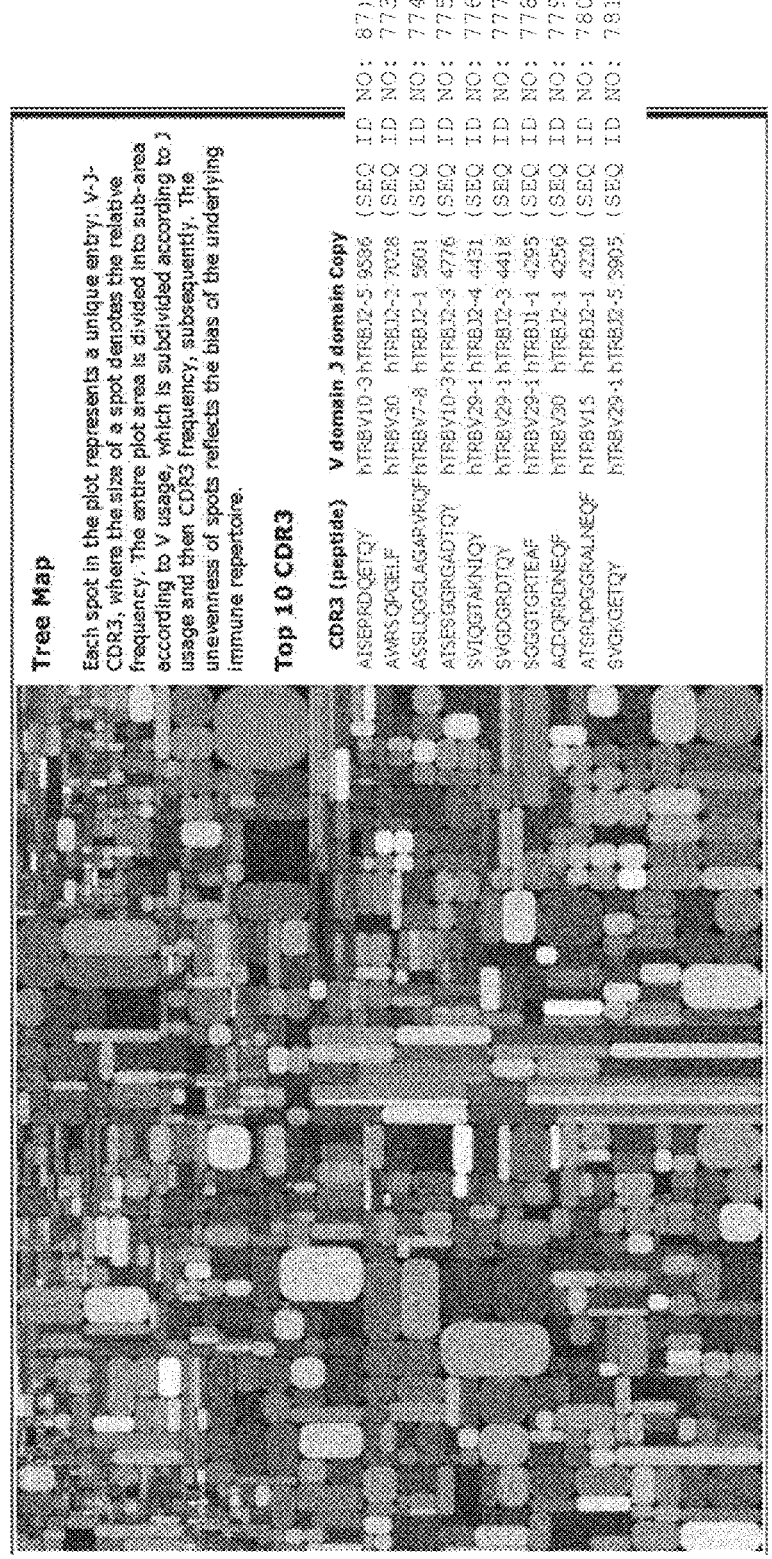
Figure 46 contd
C) TRB CFSE-High

Figure 46 contd
D) TRB CFSE-Low
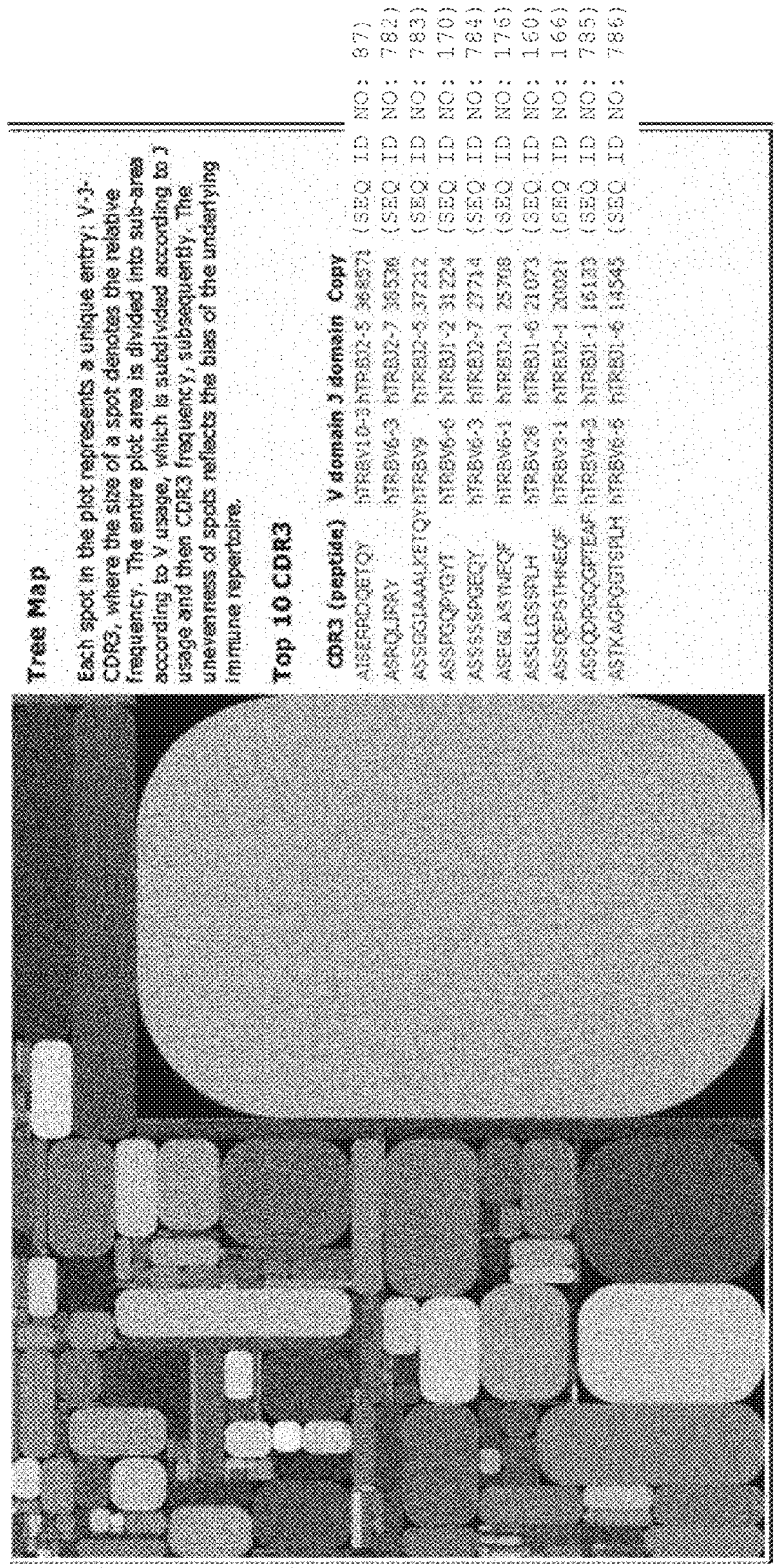

Figure 47a. SEQ1

TCR1: hTRBV28-CDR3(ASSLLGSSPLH). (SEQ ID NO: 160)

GAT GTG AAA GTA ACC CAG AGC TCG AGA TAT CTA GTC AAA AGG ACG GGA GAG AAA GTT (SEQ ID NO: 1593)
tttctggaatgtgtccaggatatggaccatgaaaatatgttctggtatcgacaagacccaggtctgggggctacggctgatctatttctcaTATGATGT
TAAAATGAAAGAAAAAGGAGATATTCCTGAGGGGTACAGTGTCTCTAGAGAGAAGAAGGAGCGCTTCTCCCTGAT
TCTGGAGTCCGCCAGCACCAACCAGACATCTATGTACCTCTGTGCCAGCAGTTTATTGGGGAGCTCAccccctccactttg
ggaatgggaccaggctcactgtgacagaggacctgaacaaggtgttcccacccgaggtcgctgtgtttgagccatcaga (SEQ ID NO: 1594)

```
    1: D   V   K   V   T   Q   S   S   R   Y   L   V   K   R   T   G   E   K   V   F
        GATGTGAAAGTAACCCAGAGCTCGAGATATCTAGTCAAAAGGACGGGAGAGAAAGTTTTT
     1  ----------|----------|----------|----------|----------|----------| 60
        CTACACTTTCATTGGGTCTCGAGCTCTATAGATCAGTTTTCCTGCCCTCTCTTTCAAAAA

1: L   E   C   V   Q   D   M   D   H   E   N   M   F   W   Y   R   Q   D   P   G
        CTGGAATGTGTCCAGGATATGGACCATGAAAATATGTTCTGGTATCGACAAGACCCAGGT
    61  ----------|----------|----------|----------|----------|----------| 120
        GACCTTACACAGGTCCTATACCTGGTACTTTTATACAAGACCATAGCTGTTCTGGGTCCA

1: L   G   L   R   L   I   Y   F   S   Y   D   V   K   M   K   E   K   G   D   I
        CTGGGGCTACGGCTGATCTATTTCTCATATGATGTTAAAATGAAAGAAAAAGGAGATATT
   121  ----------|----------|----------|----------|----------|----------| 180
        GACCCCGATGCCGACTAGATAAAGAGTATACTACAATTTTACTTTCTTTTCCTCTATAA

1: P   E   G   Y   S   V   S   R   E   K   K   E   R   F   S   L   I   L   E   S
        CCTGAGGGGTACAGTGTCTCTAGAGAGAAGAAGGAGCGCTTCTCCCTGATTCTGGAGTCC
   181  ----------|----------|----------|----------|----------|----------| 240
        GGACTCCCCATGTCACAGAGATCTCTCTTCTTCCTCGCGAAGAGGGACTAAGACCTCAGG

1: A   S   T   N   Q   T   S   M   Y   L   C   A   S   S   L   L   G   S   S   P
        GCCAGCACCAACCAGACATCTATGTACCTCTGTGCCAGCAGTTTATTGGGGAGCTCACCC
   241  ----------|----------|----------|----------|----------|----------| 300
        CGGTCGTGGTTGGTCTGTAGATACATGGAGACACGGTCGTCAAATAACCCCTCGAGTGGG

1: L   H   F   G   N   G   T   R   L   T   V   T   E   D   L   N   K   V   F   P
        CTCCACTTTGGGAATGGGACCAGGCTCACTGTGACAGAGGACCTGAACAAGGTGTTCCCA
   301  ----------|----------|----------|----------|----------|----------| 360
        GAGGTGAAACCCTTACCCTGGTCCGAGTGACACTGTCTCCTGGACTTGTTCCACAAGGGT

1: P   E   V   A   V   F   E   P   S   (SEQ ID NO: 788)
        CCCGAGGTCGCTGTGTTTGAGCCATCAGA (SEQ ID NO: 787)
   361  ----------|----------|--------- 389
        GGGCTCCAGCGACACAAACTCGGTAGTCT (SEQ ID NO: 1595)
```

Figure 47b. SEQ2

TCR1: hTRAV38-2/DV8-CDR3 (AYRSYNQGGKLI) (SEQ ID NO: 163)

GCT CAG ACA GTC ACT CAG TCT CAA CCA GAG ATG TCT GTG CAG GAG GCA GAG ACC (SEQ ID NO: 1596)
gtgaccctgagctgcacatatgacaccagtgagagtgattattatttattctggtacaagcagcctcccagcaggcagatgattctcgttatTCGCCA
AGAAGCTTATAAGCAACAGAATGCAACAGAGAATCGTTTCTCTGTGAACTTCCAGAAAGCAGCCAAATCCTTCAGT
CTCAAGATCTCAGACTCACAGCTGGGGGATGCCGCGATGTATTTCTGTGCTTATAGGAGTTATAACCagggaggaaag
cttatcttcggacagggaacggagttatctgtgaaacccaatatccagaaccctgaccctgccgtgtaccagctgagagact (SEQ ID NO: 1597)

```
1: A  Q  T  V  T  Q  S  Q  P  E  M  S  V  Q  E  A  E  T  V  T
   GCTCAGACAGTCACTCAGTCTCAACCAGAGATGTCTGTGCAGGAGGCAGAGACCGTGACC
1  ----------!----------!----------!----------!----------!----------! 60
   CGAGTCTGTCAGTGAGTCAGAGTTGGTCTCTACAGACACGTCCTCCGTCTCTGGCACTGG

1: L  S  C  T  Y  D  T  S  E  S  D  Y  Y  L  F  W  Y  K  Q  P
   CTGAGCTGCACATATGACACCAGTGAGAGTGATTATTATTTATTCTGGTACAAGCAGCCT
61 ----------!----------!----------!----------!----------!----------! 120
   GACTCGACGTGTATACTGTGGTCACTCTCACTAATAATAAATAAGACCATGTTCGTCGGA

1: P  S  R  Q  M  I  L  V  I  R  Q  E  A  Y  K  Q  Q  N  A  T
   CCCAGCAGGCAGATGATTCTCGTTATTCGCCAAGAAGCTTATAAGCAACAGAATGCAACA
121 ----------!----------!----------!----------!----------!----------! 180
   GGGTCGTCCGTCTACTAAGAGCAATAAGCGGTTCTTCGAATATTCGTTGTCTTACGTTGT

1: E  N  R  F  S  V  N  F  Q  K  A  A  K  S  F  S  L  K  I  S
   GAGAATCGTTTCTCTGTGAACTTCCAGAAAGCAGCCAAATCCTTCAGTCTCAAGATCTCA
181 ----------!----------!----------!----------!----------!----------! 240
   CTCTTAGCAAAGAGACACTTGAAGGTCTTTCGTCGGTTTAGGAAGTCAGAGTTCTAGAGT

1: D  S  Q  L  G  D  A  A  M  Y  F  C  A  Y  R  S  Y  N  Q  G
   GACTCACAGCTGGGGGATGCCGCGATGTATTTCTGTGCTTATAGGAGTTATAACCAGGGA
241 ----------!----------!----------!----------!----------!----------! 300
   CTGAGTGTCGACCCCCTACGGCGCTACATAAAGACACGAATATCCTCAATATTGGTCCCT

1: G  K  L  I  F  G  Q  G  T  E  L  S  V  K  P  N  I  Q  N  P
   GGAAAGCTTATCTTCGGACAGGGAACGGAGTTATCTGTGAAACCCAATATCCAGAACCCT
301 ----------!----------!----------!----------!----------!----------! 360
   CCTTTCGAATAGAAGCCTGTCCCTTGCCTCAATAGACACTTTGGGTTATAGGTCTTGGGA

1: D  P  A  V  Y  Q  L  R  D  (SEQ ID NO: 790)
   GACCCTGCCGTGTACCAGCTGAGAGACT (SEQ ID NO: 789)
361 ----------!----------!--------- 388
   CTGGGACGGCACATGGTCGACTCTCTGA (SEQ ID NO: 1598)
```

Figure 48a. SEQ5

TCR4: hTRBV3-1-CDR3 (ASSQEPSTHNEQF). (SEQ ID NO: 166)

GAC ACA GCT GTT TCC CAG ACT CCA AAA TAC CTG GTC ACA CAG ATG GGA AAC GAC AAG (SEQ ID NO: 1599)
tccattaaatgtgaacaaaatctgggccatgatactatgtattggtataaacaggactctaagaaatttctgaagataatgtttagctacaataatAA
GGAGCTCATTATAAATGAAACAGTTCCAAATCGCTTCTCACCTAAATCTCCAGACAAAGCTCACTTAAATCTTCACA
TCAATTCCCTGGAGCTTGGTGACTCTGCTGTGTATTTCTGTGCCAGCAGCCAAGAGCCTAGTACCcacaatgagcagttc
ttcgggccagggacacggctcaccgtgctagaggacctgaaaaacgtgttcccacccgaggtcgctgtgtttgagccatcaga
(SEQ ID NO: 1600)

```
    1: D   T   A   V   S   Q   T   P   K   Y   L   V   T   Q   M   G   N   D   K   S
       GACACAGCTGTTTCCCAGACTCCAAAATACCTGGTCACACAGATGGGAAACGACAAGTCC
    1  ----------!----------!----------!----------!----------!----------! 60
       CTGTGTCGACAAAGGGTCTGAGGTTTTATGGACCAGTGTGTCTACCCTTTGCTGTTCAGG

1: I   K   C   E   Q   N   L   G   H   D   T   M   Y   W   Y   K   Q   D   S   K
       ATTAAATGTGAACAAAATCTGGGCCATGATACTATGTATTGGTATAAACAGGACTCTAAG
   61  ----------!----------!----------!----------!----------!----------! 120
       TAATTTACACTTGTTTTAGACCCGGTACTATGATACATAACCATATTTGTCCTGAGATTC

1: K   F   L   K   I   M   F   S   Y   N   N   K   E   L   I   I   N   E   T   V
       AAATTTCTGAAGATAATGTTTAGCTACAATAATAAGGAGCTCATTATAAATGAAACAGTT
  121  ----------!----------!----------!----------!----------!----------! 180
       TTTAAAGACTTCTATTACAAATCGATGTTATTATTCCTCGAGTAATATTTACTTTGTCAA

1: P   N   R   F   S   P   K   S   P   D   K   A   H   L   N   L   H   I   N   S
       CCAAATCGCTTCTCACCTAAATCTCCAGACAAAGCTCACTTAAATCTTCACATCAATTCC
  181  ----------!----------!----------!----------!----------!----------! 240
       GGTTTAGCGAAGAGTGGATTTAGAGGTCTGTTTCGAGTGAATTTAGAAGTGTAGTTAAGG

1: L   E   L   G   D   S   A   V   Y   F   C   A   S   S   Q   E   P   S   T   H
       CTGGAGCTTGGTGACTCTGCTGTGTATTTCTGTGCCAGCAGCCAAGAGCCTAGTACCCAC
  241  ----------!----------!----------!----------!----------!----------! 300
       GACCTCGAACCACTGAGACGACACATAAAGACACGGTCGTCGGTTCTCGGATCATGGGTG

1: N   E   Q   F   F   G   P   G   T   R   L   T   V   L   E   D   L   K   N   V
       AATGAGCAGTTCTTCGGGCCAGGGACACGGCTCACCGTGCTAGAGGACCTGAAAAACGTG
  301  ----------!----------!----------!----------!----------!----------! 360
       TTACTCGTCAAGAAGCCCGGTCCCTGTGCCGAGTGGCACGATCTCCTGGACTTTTTGCAC

1: F   P   P   E   V   A   V   F   E   P   S   (SEQ ID NO: 792)
       TTCCCACCCGAGGTCGCTGTGTTTGAGCCATCAGA  (SEQ ID NO: 791)
  361  ----------!----------!----------!----- 395
       AAGGGTGGGCTCCAGCGACACAAACTCGGTAGTCT   (SEQ ID NO: 1601)
```

Figure 48b. SEQ6

TCR4: hTRAV26-2-CDR3 (ILKNYGGSQGNLI) (SEQ ID NO: 167)

GAT GCT AAG ACC ACA CAG CCA AAT TCA ATG GAG AGT AAC GAA GAA GAG CCT (SEQ ID NO: 1504)
gttcacttgccttgtaaccactccacaatcagtggaactgattacatacattggtatcgacagcttccctcccagggtccagagtaCGTGATTCATG
GTCTTACAAGCAATGTGAACAACAGAATGGCCTCTCTGGCAATCGCTGAAGACAGAAAGTCCAGTACCTTGATCCT
GCACCGTGCTACCTTGAGAGATGCTGCTGTGTACTACTGCATCCTGAAGAATTATGGAGGAAGCCAAGGaaatctca
tctttggaaaaggcactaaactctctgttaaaccaaatatccagaaccctgaccctgccgtgtaccagctgagagact (SEQ ID NO: 1602)

```
  1: D  A  K  T  T  Q  P  N  S  M  E  S  N  E  E  E  P  V  H  L
     GATGCTAAGACCACACAGCCAAATTCAATGGAGAGTAACGAAGAAGAGCCTGTTCACTTG
  1  ----------|----------|----------|----------|----------|----------| 60
     CTACGATTCTGGTGTGTCGGTTTAAGTTACCTCTCATTGCTTCTTCTCGGACAAGTGAAC

1: P  C  N  H  S  T  I  S  G  T  D  Y  I  H  W  Y  R  Q  L  P
     CCTTGTAACCACTCCACAATCAGTGGAACTGATTACATACATTGGTATCGACAGCTTCCC
 61  ----------|----------|----------|----------|----------|----------| 120
     GGAACATTGGTGAGGTGTTAGTCACCTTGACTAATGTATGTAACCATAGCTGTCGAAGGG

1: S  Q  G  P  E  Y  V  I  H  G  L  T  S  N  V  N  N  R  M  A
     TCCCAGGGTCCAGAGTACGTGATTCATGGTCTTACAAGCAATGTGAACAACAGAATGGCC
121  ----------|----------|----------|----------|----------|----------| 180
     AGGGTCCCAGGTCTCATGCACTAAGTACCAGAATGTTCGTTACACTTGTTGTCTTACCGG

1: S  L  A  I  A  E  D  R  K  S  S  T  L  I  L  H  R  A  T  L
     TCTCTGGCAATCGCTGAAGACAGAAAGTCCAGTACCTTGATCCTGCACCGTGCTACCTTG
181  ----------|----------|----------|----------|----------|----------| 240
     AGAGACCGTTAGCGACTTCTGTCTTTCAGGTCATGGAACTAGGACGTGGCACGATGGAAC

1: R  D  A  A  V  Y  Y  C  I  L  K  N  Y  G  G  S  Q  G  N  L
     AGAGATGCTGCTGTGTACTACTGCATCCTGAAGAATTATGGAGGAAGCCAAGGAAATCTC
241  ----------|----------|----------|----------|----------|----------| 300
     TCTCTACGACGACACATGATGACGTAGGACTTCTTAATACCTCCTTCGGTTCCTTTAGAG

1: I  F  G  K  G  T  K  L  S  V  K  P  N  I  Q  N  P  D  P  A
     ATCTTTGGAAAAGGCACTAAACTCTCTGTTAAACCAAATATCCAGAACCCTGACCCTGCC
301  ----------|----------|----------|----------|----------|----------| 360
     TAGAAACCTTTTCCGTGATTTGAGAGACAATTTGGTTTATAGGTCTTGGGACTGGGACGG

1: V  Y  Q  L  R  D  (SEQ ID NO: 794)
     GTGTACCAGCTGAGAGACT (SEQ ID NO: 793)
361  ----------|--------- 379
     CACATGGTCGACTCTCTGA (SEQ ID NO: 1603)
```

Figure 49a. SEQ7

TCR5: hTRBV6-6-CDR3 (ASSPGQPYGYT). (SEQ ID NO: 170)

AAT GCT GGT GTC ACT CAG ACC CCA AAA TTC CGC ATC CTG AAG ATA GGA CAG (SEQ ID NO: 1604)
agcatgacactgcagtgtacccaggatatgaaccataactacatgtactggtatcgacaagacccaggcatgggggctgaagctgatttattattcaGT
TGGTGCTGGTATCACTGATAAAGGAGAAGTCCCGAATGGCTACAACGTCTCCAGATCAACCACAGAGGATTTCCC
GCTCAGGCTGGAGTTGGCTGCTCCCTCCCAGACATCTGTGTACTTCTGTGCCAGCAGCCCGGGACAgccctatggctac
accttcggttcggggaccaggttaaccgttgtagaggacctgaacaaggtgttccacccgaggtcgctgtgtttgagccatcaga
(SEQ ID NO: 1605)

```
   1: N   A   G   V   T   Q   T   P   K   F   R   I   L   K   I   G   Q   S   M   T
      AATGCTGGTGTCACTCAGACCCCAAAATTCCGCATCCTGAAGATAGGACAGAGCATGACA
   1  ----------|----------|----------|----------|----------|----------| 60
      TTACGACCACAGTGAGTCTGGGGTTTTAAGGCGTAGGACTTCTATCCTGTCTCGTACTGT

1: L   Q   C   T   Q   D   M   N   H   N   Y   M   Y   W   Y   R   Q   D   P   G
      CTGCAGTGTACCCAGGATATGAACCATAACTACATGTACTGGTATCGACAAGACCCAGGC
  61  ----------|----------|----------|----------|----------|----------| 120
      GACGTCACATGGGTCCTATACTTGGTATTGATGTACATGACCATAGCTGTTCTGGGTCCG

1: M   G   L   K   L   I   Y   Y   S   V   G   A   G   I   T   D   K   G   E   V
      ATGGGGCTGAAGCTGATTTATTATTCAGTTGGTGCTGGTATCACTGATAAAGGAGAAGTC
 121  ----------|----------|----------|----------|----------|----------| 180
      TACCCCGACTTCGACTAAATAATAAGTCAACCACGACCATAGTGACTATTTCCTCTTCAG

1: P   N   G   Y   N   V   S   R   S   T   T   E   D   F   P   L   R   L   E   L
      CCGAATGGCTACAACGTCTCCAGATCAACCACAGAGGATTTCCCGCTCAGGCTGGAGTTG
 181  ----------|----------|----------|----------|----------|----------| 240
      GGCTTACCGATGTTGCAGAGGTCTAGTTGGTGTCTCCTAAAGGGCGAGTCCGACCTCAAC

1: A   A   P   S   Q   T   S   V   Y   F   C   A   S   S   P   G   Q   P   Y   G
      GCTGCTCCCTCCCAGACATCTGTGTACTTCTGTGCCAGCAGCCCGGGACAGCCCTATGGC
 241  ----------|----------|----------|----------|----------|----------| 300
      CGACGAGGGAGGGTCTGTAGACACATGAAGACACGGTCGTCGGGCCCTGTCGGGATACCG

1: Y   T   F   G   S   G   T   R   L   T   V   V   E   D   L   N   K   V   F   P
      TACACCTTCGGTTCGGGGACCAGGTTAACCGTTGTAGAGGACCTGAACAAGGTGTTCCCA
 301  ----------|----------|----------|----------|----------|----------| 360
      ATGTGGAAGCCAAGCCCCTGGTCCAATTGGCAACATCTCCTGGACTTGTTCCACAAGGGT

1: F   E   V   A   V   F   E   P   S  (SEQ ID NO: 796)
      CCCGAGGTCGCTGTGTTTGAGCCATCAGA (SEQ ID NO: 795)
 361  ----------|----------|--------- 389
      GGGCTCCAGCGACACAAACTCGGTAGTCT (SEQ ID NO: 1606)
```

Figure 49b. SEQ8

TCR5 hTRAV16-CDR3 (ALSGPSYGQNFV) (SEQ ID NO: 173)

GCC CAG AGA GTG ACT CAG CCC GAG AAG CTC CTC TCT GTC TTT AAA GGG GCC CCA (SEQ ID NO: 1607)
gtggagctgaagtgcaactattcctattctgggagtcctgaactcttctggtatgtccagtactccagacaacgcctCCAGTTACTCTTGAGACA
CATCTCTAGAGAGAGCATCAAAGGCTTCACTGCTGACCTTAACAAAGGCGAGACATCTTTCCACCTGAAGAAACCA
TTTGCTCAAGAGGAAGACTCAGCCATGTATTACTGTGCTCTAAGTGGCCCGAGCTATGGTCAGAATTTTGTctttggtc
ccggaaccagattgtccgtgctgccctatatccagaaccctgaccctgccgtgtaccagctgagagact (SEQ ID NO: 1608)

```
  1: A  Q  R  V  T  Q  P  E  K  L  L  S  V  F  K  G  A  P  V  E
     GCCCAGAGAGTGACTCAGCCCGAGAAGCTCCTCTCTGTCTTTAAAGGGGCCCCAGTGGAG
  1  ----------!----------!----------!----------!----------!----------! 60
     CGGGTCTCTCACTGAGTCGGGCTCTTCGAGGAGAGACAGAAATTTCCCCGGGGTCACCTC

1: L  K  C  N  Y  S  Y  S  G  S  P  E  L  F  W  Y  V  Q  Y  S
     CTGAAGTGCAACTATTCCTATTCTGGGAGTCCTGAACTCTTCTGGTATGTCCAGTACTCC
 61  ----------!----------!----------!----------!----------!----------! 120
     GACTTCACGTTGATAAGGATAAGACCCTCAGGACTTGAGAAGACCATACAGGTCATGAGG

1: R  Q  R  L  Q  L  L  R  H  I  S  R  E  S  I  K  G  F  T
     AGACAACGCCTCCAGTTACTCTTGAGACACATCTCTAGAGAGAGCATCAAAGGCTTCACT
 121 ----------!----------!----------!----------!----------!----------! 180
     TCTGTTGCGGAGGTCAATGAGAACTCTGTGTAGAGATCTCTCGTAGTTTCCGAAGTGA

1: A  D  L  N  K  G  E  T  S  F  H  L  K  K  P  F  A  Q  E  E
     GCTGACCTTAACAAAGGCGAGACATCTTTCCACCTGAAGAAACCATTTGCTCAAGAGGAA
 181 ----------!----------!----------!----------!----------!----------! 240
     CGACTGGAATTGTTTCCGCTCTGTAGAAAGGTGGACTTCTTTGGTAAACGAGTTCTCCTT

1: D  S  A  M  Y  Y  C  A  L  S  G  P  S  Y  G  Q  N  F  V  F
     GACTCAGCCATGTATTACTGTGCTCTAAGTGGCCCGAGCTATGGTCAGAATTTTGTCTTT
 241 ----------!----------!----------!----------!----------!----------! 300
     CTGAGTCGGTACATAATGACACGAGATTCACCGGGCTCGATACCAGTCTTAAAACAGAAA

1: G  P  G  T  R  L  S  V  L  P  Y  I  Q  N  P  D  P  A  V  Y
     GGTCCCGGAACCAGATTGTCCGTGCTGCCCTATATCCAGAACCCTGACCCTGCCGTGTAC
 301 ----------!----------!----------!----------!----------!----------! 360
     CCAGGGCCTTGGTCTAACAGGCACGACGGGATATAGGTCTTGGGACTGGGACGGCACATG

1: Q  L  R  D (SEQ ID NO: 798)
     CAGCTGAGAGACT (SEQ ID NO: 797)
 361 ----------!---- 373
     GTCGACTCTCTGA (SEQ ID NO: 1609)
```

Figure 50a. SEQ9

TCR6: hTRBV6-1-CDR3 (ASEGLASYNEQF). (SEQ ID NO: 176)

AAT GCT GGT GTC ACT CAG ACC CCA AAA TTC CAG GTC CTG AAG ACA GGA CAG (SEQ ID NO: 1610)
Agcatgacactgcagtgtgcccaggatatgaaccataactccatgtactggtatcgacaagacccaggcatgggactgaggctgatttattactcagc
tTCTGAGGGTACCACTGACAAAGGAGAAGTCCCCAATGGCTACAATGTCTCCAGATTAAACAAACGGGAGTTCTCG
CTCAGGCTGGAGTCGGCTGCTCCCTCCCAGACATCTGTGTACTTCTgtgccagcgagggactagcctcctacaatgagcagttctt
cgggccagggacacggctcaccgtgctagaggacctgaaaaacgtgttcccacccgaggtcgctgtgtttgagccatcaga (SEQ ID NO: 1611)

```
  1: N   A   G   V   T   Q   T   P   K   F   Q   V   L   K   T   G   Q   S   M   T
     AATGCTGGTGTCACTCAGACCCCAAAATTCCAGGTCCTGAAGACAGGACAGAGCATGACA
  1  ----------!----------!----------!----------!----------!----------! 60
     TTACGACCACAGTGAGTCTGGGGTTTTAAGGTCCAGGACTTCTGTCCTGTCTCGTACTGT

1: L   Q   C   A   Q   D   M   N   H   N   S   M   Y   W   Y   R   Q   D   P   G
     CTGCAGTGTGCCCAGGATATGAACCATAACTCCATGTACTGGTATCGACAAGACCCAGGC
 61  ----------!----------!----------!----------!----------!----------! 120
     GACGTCACACGGGTCCTATACTTGGTATTGAGGTACATGACCATAGCTGTTCTGGGTCCG

1: M   G   L   R   L   I   Y   Y   S   A   S   E   G   T   T   D   K   G   E   V
     ATGGGACTGAGGCTGATTTATTACTCAGCTTCTGAGGGTACCACTGACAAAGGAGAAGTC
121  ----------!----------!----------!----------!----------!----------! 180
     TACCCTGACTCCGACTAAATAATGAGTCGAAGACTCCCATGGTGACTGTTTCCTCTTCAG

1: P   N   G   Y   N   V   S   R   L   N   K   R   E   F   S   L   R   L   E   S
     CCCAATGGCTACAATGTCTCCAGATTAAACAAACGGGAGTTCTCGCTCAGGCTGGAGTCG
181  ----------!----------!----------!----------!----------!----------! 240
     GGGTTACCGATGTTACAGAGGTCTAATTTGTTTGCCCTCAAGAGCGAGTCCGACCTCAGC

1: A   A   P   S   Q   T   S   V   Y   F   C   A   S   E   G   L   A   S   Y   N
     GCTGCTCCCTCCCAGACATCTGTGTACTTCTGTGCCAGCGAGGGACTAGCCTCCTACAAT
241  ----------!----------!----------!----------!----------!----------! 300
     CGACGAGGGAGGGTCTGTAGACACATGAAGACACGGTCGCTCCCTGATCGGAGGATGTTA

1: E   Q   F   F   G   P   G   T   R   L   T   V   L   E   D   L   K   N   V   F
     GAGCAGTTCTTCGGGCCAGGGACACGGCTCACCGTGCTAGAGGACCTGAAAAACGTGTTC
301  ----------!----------!----------!----------!----------!----------! 360
     CTCGTCAAGAAGCCCGGTCCCTGTGCCGAGTGGCACGATCTCCTGGACTTTTTGCACAAG

1: P   P   E   V   A   V   F   E   P   S   (SEQ ID NO: 800)
     CCACCCGAGGTCGCTGTGTTTGAGCCATCAGA (SEQ ID NO: 799)
361  ----------!----------!----------!--- 392
     GGTGGGCTCCAGCGACACAAACTCGGTAGTCT (SEQ ID NO: 1612)
```

Figure 50b. SEQ10

TCR6: hTRAV9-2-CDR3 (ALTGGGYQKVT) (SEQ ID NO: 179)

GGA AAT TCA GTG ACC CAG ATG GAA GGG CCA GTG ACT CTC TCA GAA GAG GCC TTC (SEQ ID NO: 1613)
ctgactataaactgcacgtacacagccacaggatacccttcccttttctggtatgtccaatatcctggagaaggtctacagctCCTCCTGAAAGCC
ACGAAGGCTGATGACAAGGGAAGCAACAAAGGTTTTGAAGCCACATACCGTAAAGAAACCACTTCTTTCCACTTG
GAGAAAGGCTCAGTTCAAGTGTCAGACTCAGCGGTGTACTTCTGTGCtctaacggggggggggttaccagaaagttacctttgga
actggaacaaagctccaagtcatcccaaatatccagaaccctgaccctgccgtgtaccagctgagagact (SEQ ID NO: 1614)

```
1: G  N  S  V  T  Q  M  E  G  P  V  T  L  S  E  E  A  F  L  T
   GGAAATTCAGTGACCCAGATGGAAGGGCCAGTGACTCTCTCAGAAGAGGCCTTCCTGACT
 1 ----------|----------|----------|----------|----------|----------| 60
   CCTTTAAGTCACTGGGTCTACCTTCCCGGTCACTGAGAGAGTCTTCTCCGGAAGGACTGA

1: I  N  C  T  Y  T  A  T  G  Y  P  S  L  F  W  Y  V  Q  Y  P
   ATAAACTGCACGTACACAGCCACAGGATACCCTTCCCTTTTCTGGTATGTCCAATATCCT
61 ----------|----------|----------|----------|----------|----------| 120
   TATTTGACGTGCATGTGTCGGTGTCCTATGGGAAGGGAAAAGACCATACAGGTTATAGGA

1: G  E  G  L  Q  L  L  L  K  A  T  K  A  D  D  K  G  S  N  K
   GGAGAAGGTCTACAGCTCCTCCTGAAAGCCACGAAGGCTGATGACAAGGGAAGCAACAAA
121 ----------|----------|----------|----------|----------|----------| 180
   CCTCTTCCAGATGTCGAGGAGGACTTTCGGTGCTTCCGACTACTGTTCCCTTCGTTGTTT

1: G  F  E  A  T  Y  R  K  E  T  T  S  F  H  L  E  K  G  S  V
   GGTTTTGAAGCCACATACCGTAAAGAAACCACTTCTTTCCACTTGGAGAAAGGCTCAGTT
181 ----------|----------|----------|----------|----------|----------| 240
   CCAAAACTTCGGTGTATGGCATTTCTTTGGTGAAGAAAGGTGAACCTCTTTCCGAGTCAA

1: Q  V  S  D  S  A  V  Y  F  C  A  L  T  G  G  G  Y  Q  K  V
   CAAGTGTCAGACTCAGCGGTGTACTTCTGTGCTCTAACGGGGGGGGGTTACCAGAAAGTT
241 ----------|----------|----------|----------|----------|----------| 300
   GTTCACAGTCTGAGTCGCCACATGAAGACACGAGATTGCCCCCCCCCAATGGTCTTTCAA

1: T  F  G  T  G  T  K  L  Q  V  I  P  N  I  Q  N  P  D  P  A
   ACCTTTGGAACTGGAACAAAGCTCCAAGTCATCCCAAATATCCAGAACCCTGACCCTGCC
301 ----------|----------|----------|----------|----------|----------| 360
   TGGAAACCTTGACCTTGTTTCGAGGTTCAGTAGGGTTTATAGGTCTTGGGACTGGGACGG

1: V  Y  Q  L  R  D (SEQ ID NO: 802)
   GTGTACCAGCTGAGAGACT (SEQ ID NO: 801)
361 ----------|------- 379
   CACATGGTCGACTCTCTGA (SEQ ID NO: 1615)
```

Figure 51a. SEQ11

TCR7: hTRBV27-CDR3 (ASSFREGEKLF). (SEQ ID NO: 181)

GAA GCC CAA GTG ACC CAG AAC CCA AGA TAC CTC ATC ACA GTG ACT GGA AAG AAG TTA (SEQ ID NO: 1616)
acagtgacttgttctcagaatatgaaccatgagtatatgtcctggtatcgacaagacccagggctgggcttaaggcagatctactattcaATGAATG
TTGAGGTGACTGATAAGGGAGATGTTCCTGAAGGGTACAAAGTCTCTCGAAAAGAGAAGAGGAATTTCCCCCTGA
TCCTGGAGTCGCCCAGCCCCAACCAGACCTCTCTGTACTTCTGTGCCAGCAGTTTCAGGGAGGGTGAAaaactgttttt
tggcagtggaacccagctctctgtcttggaggacctgaacaaggtgttcccacccgaggtcgctgtgtttgagccatcaga (SEQ ID NO: 1617)

```
    1:  E   A   Q   V   T   Q   N   P   R   Y   L   I   T   V   T   G   K   K   L   T
        GAAGCCCAAGTGACCCAGAACCCAAGATACCTCATCACAGTGACTGGAAAGAAGTTAACA
    1   ----------!----------!----------!----------!----------!----------! 60
        CTTCGGGTTCACTGGGTCTTGGGTTCTATGGAGTAGTGTCACTGACCTTTCTTCAATTGT

1:  V   T   C   S   Q   N   M   N   H   E   Y   M   S   W   Y   R   Q   D   P   G
        GTGACTTGTTCTCAGAATATGAACCATGAGTATATGTCCTGGTATCGACAAGACCCAGGG
   61   ----------!----------!----------!----------!----------!----------! 120
        CACTGAACAAGAGTCTTATACTTGGTACTCATATACAGGACCATAGCTGTTCTGGGTCCC

1:  L   G   L   R   Q   I   Y   Y   S   M   N   V   E   V   T   D   K   G   D   V
        CTGGGCTTAAGGCAGATCTACTATTCAATGAATGTTGAGGTGACTGATAAGGGAGATGTT
  121   ----------!----------!----------!----------!----------!----------! 180
        GACCCGAATTCCGTCTAGATGATAAGTTACTTACAACTCCACTGACTATTCCCTCTACAA

1:  P   E   G   Y   K   V   S   R   K   E   K   R   N   F   P   L   I   L   E   S
        CCTGAAGGGTACAAAGTCTCTCGAAAAGAGAAGAGGAATTTCCCCCTGATCCTGGAGTCG
  181   ----------!----------!----------!----------!----------!----------! 240
        GGACTTCCCATGTTTCAGAGAGCTTTTCTCTTCTCCTTAAAGGGGACTAGGACCTCAGC

1:  P   S   P   N   Q   T   S   L   Y   F   C   A   S   S   F   R   E   G   E   K
        CCCAGCCCCAACCAGACCTCTCTGTACTTCTGTGCCAGCAGTTTCAGGGAGGGTGAAAAA
  241   ----------!----------!----------!----------!----------!----------! 300
        GGGTCGGGGTTGGTCTGGAGAGACATGAAGACACGGTCGTCAAAGTCCCTCCCACTTTTT

1:  L   F   F   G   S   G   T   Q   L   S   V   L   E   D   L   N   K   V   F   P
        CTGTTTTTTGGCAGTGGAACCCAGCTCTCTGTCTTGGAGGACCTGAACAAGGTGTTCCCA
  301   ----------!----------!----------!----------!----------!----------! 360
        GACAAAAAACCGTCACCTTGGGTCGAGAGACAGAACCTCCTGGACTTGTTCCACAAGGGT

1:  P   E   V   A   V   F   E   P   S  (SEQ ID NO: 804)
        CCCGAGGTCGCTGTGTTTGAGCCATCAGA (SEQ ID NO: 803)
  361   ----------!----------!---------- 389
        GGGCTCCAGCGACACAAACTCGGTAGTCT (SEQ ID NO: 1618)
```

Figure 51b. SEQ12

TCR7: hTRAV17-CDR3 (ATAMNTGFQKLV) (SEQ ID NO: 184)

AGT CAA CAG GGA GAA GAG GAT CCT CAG GCC TTG AGC ATC CAG GAG GGT GAA AAT (SEQ ID NO: 1619)
gccaccatgaactgcagttacaaaactagtataaacaatttacagtggtatagacaaaattcaggtagaggccttgtccacctAATTTTAATACG
TTCAAATGAAAGAGAGAAACACAGTGGAAGATTAAGAGTCACGCTTGACACTTCCAAGAAAAGCAGTTCCTTGTT
GATCACGGCTTCCCGGGCAGCAGACACTGCTTCTtacttctgtgctacggcgatgaacacaggctttcagaaacttgtatttggaactg
gcacccgacttctggtcagtccaaatatccagaaccctgaccctgccgtgtaccagctgagagact (SEQ ID NO: 1620)

```
   1:  S   Q   Q   G   E   E   D   P   Q   A   L   S   I   Q   E   G   E   N   A   T
       AGTCAACAGGGAGAAGAGGATCCTCAGGCCTTGAGCATCCAGGAGGGTGAAAATGCCACC
     1 ----------!----------!----------!----------!----------!----------!  60
       TCAGTTGTCCCTCTTCTCCTAGGAGTCCGGAACTCGTAGGTCCTCCCACTTTTACGGTGG

1:  M   N   C   S   Y   K   T   S   I   N   N   L   Q   W   Y   R   Q   N   S   G
       ATGAACTGCAGTTACAAAACTAGTATAAACAATTTACAGTGGTATAGACAAAATTCAGGT
    61 ----------!----------!----------!----------!----------!----------! 120
       TACTTGACGTCAATGTTTTGATCATATTTGTTAAATGTCACCATATCTGTTTTAAGTCCA

1:  R   G   L   V   H   L   I   L   I   R   S   N   E   R   E   K   H   S   G   R
       AGAGGCCTTGTCCACCTAATTTTAATACGTTCAAATGAAAGAGAGAAACACAGTGGAAGA
   121 ----------!----------!----------!----------!----------!----------! 180
       TCTCCGGAACAGGTGGATTAAAATTATGCAAGTTTACTTTCTCTCTTTGTGTCACCTTCT

1:  L   R   V   T   L   D   T   S   K   K   S   S   L   L   I   T   A   S   R
       TTAAGAGTCACGCTTGACACTTCCAAGAAAAGCAGTTCCTTGTTGATCACGGCTTCCCGG
   181 ----------!----------!----------!----------!----------!----------! 240
       AATTCTCAGTGCGAACTGTGAAGGTTCTTTTCGTCAAGGAACAACTAGTGCCGAAGGGCC

1:  A   A   D   T   A   S   Y   F   C   A   T   A   M   N   T   G   F   Q   K   L
       GCAGCAGACACTGCTTCTTACTTCTGTGCTACGGCGATGAACACAGGCTTTCAGAAACTT
   241 ----------!----------!----------!----------!----------!----------! 300
       CGTCGTCTGTGACGAAGAATGAAGACACGATGCCGCTACTTGTGTCCGAAAGTCTTTGAA

1:  V   F   G   T   G   T   R   L   L   V   S   P   N   I   Q   N   P   D   P   A
       GTATTTGGAACTGGCACCCGACTTCTGGTCAGTCCAAATATCCAGAACCCTGACCCTGCC
   301 ----------!----------!----------!----------!----------!----------! 360
       CATAAACCTTGACCGTGGGCTGAAGACCAGTCAGGTTTATAGGTCTTGGGACTGGGACGG

1:  V   Y   Q   L   R   D  (SEQ ID NO: 806)
       GTGTACCAGCTGAGAGACT  (SEQ ID NO: 805)
   361 ----------!-------- 379
       CACATGGTCGACTCTCTGA  (SEQ ID NO: 1621)
```

Figure 52a. SEQ13

TCR8 hTRBV4-2-CDR3 (ASSREGLAGLNEQF). (SEQ ID NO: 187)

```
GAA ACG GGA GTT ACG CAG ACA CCA AGA CAC CTG GTC ATG GGA ATG ACA AAT AAG AAG TCT (SEQ ID NO: 1622)
ttgaaatgtgaacaacatctggggcataacgctatgtattggtacaagcaaagtgctaagaagccactggagctcatgtttgtctacaactttaaaGA
ACAGACTGAAAACAACAGTGTGCCAAGTCGCTTCTCACCTGAATGCCCCAACAGCTCTCACTTATTCCTTCACCTAC
ACACCCTGCAGCCAGAAGACTCGGCCCTGTATCTCTGTGCCAGCAGCCGGGAGGGACTAGCGGGAttaaatgagcagt
tcttcgggccagggacacggctcaccgtgctagaggacctgaaaaacgtgttcccacccgaggtcgctgtgtttgagccatcaga
                                                                        (SEQ ID NO: 1623)
```

```
  1:  E   T   G   V   T   Q   T   P   R   H   L   V   M   G   M   T   N   K   K   S
      GAAACGGGAGTTACGCAGACACCAAGACACCTGGTCATGGGAATGACAAATAAGAAGTCT
  1   ----------|----------|----------|----------|----------|----------|  60
      CTTTGCCCTCAATGCGTCTGTGGTTCTGTGGACCAGTACCCTTACTGTTTATTCTTCAGA

1:  L   K   C   E   Q   H   L   G   H   N   A   M   Y   W   Y   K   Q   S   A   K
      TTGAAATGTGAACAACATCTGGGGCATAACGCTATGTATTGGTACAAGCAAAGTGCTAAG
 61   ----------|----------|----------|----------|----------|----------|  120
      AACTTTACACTTGTTGTAGACCCCGTATTGCGATACATAACCATGTTCGTTTCACGATTC

1:  K   P   L   E   L   M   F   V   Y   N   F   K   E   Q   T   E   N   N   S   V
      AAGCCACTGGAGCTCATGTTTGTCTACAACTTTAAAGAACAGACTGAAAACAACAGTGTG
121   ----------|----------|----------|----------|----------|----------|  180
      TTCGGTGACCTCGAGTACAAACAGATGTTGAAATTTCTTGTCTGACTTTTGTTGTCACAC

1:  P   S   R   F   S   P   E   C   P   N   S   S   H   L   F   L   H   L   H   T
      CCAAGTCGCTTCTCACCTGAATGCCCCAACAGCTCTCACTTATTCCTTCACCTACACACC
181   ----------|----------|----------|----------|----------|----------|  240
      GGTTCAGCGAAGAGTGGACTTACGGGGTTGTCGAGAGTGAATAAGGAAGTGGATGTGTGG

1:  L   Q   P   E   D   S   A   L   Y   L   C   A   S   S   R   E   G   L   A   G
      CTGCAGCCAGAAGACTCGGCCCTGTATCTCTGTGCCAGCAGCCGGGAGGGACTAGCGGGA
241   ----------|----------|----------|----------|----------|----------|  300
      GACGTCGGTCTTCTGAGCCGGGACATAGAGACACGGTCGTCGGCCCTCCCTGATCGCCCT

1:  L   N   E   Q   F   F   G   P   G   T   R   L   T   V   L   E   D   L   K   N
      TTAAATGAGCAGTTCTTCGGGCCAGGGACACGGCTCACCGTGCTAGAGGACCTGAAAAAC
301   ----------|----------|----------|----------|----------|----------|  360
      AATTTACTCGTCAAGAAGCCCGGTCCCTGTGCCGAGTGGCACGATCTCCTGGACTTTTTG

1:  V   F   P   P   E   V   A   V   F   E   P   S  (SEQ ID NO: 808)
      GTGTTCCCACCCGAGGTCGCTGTGTTTGAGCCATCAGA (SEQ ID NO: 807)
361   ----------|----------|----------|---------  398
      CACAAGGGTGGGCTCCAGCGACACAAACTCGGTAGTCT (SEQ ID NO: 1624)
```

Figure 52b. SEQ14

TCR8: hTRAV29/DV5-CDR3 (AASGWGDGGATNKLI) (SEQ ID NO: 190)

GAC CAG CAA GTT AAG CAA AAT TCA CCA TCC CTG AGC GTC CAG GAA (SEQ ID NO: 1625)
ggaagaatttctattctgaactgtgactatactaacagcatgtttgattatttcctatggtacaaaaaatacccctgctgaaggtcctacattcctgatatc
tatAAGTTCCATTAAGGATAAAAATGAAGATGGAAGATTCACTGTCTTCTTAAACAAAAGTGCCAAGCACCTCTCTC
TGCACATTGTGCCCTCCCAGCCTGGAGACTCTGCAGTGTACTTCTGTGCAGCAAGCGGCTGGggtgatggtggtgctaca
aacaagctcatctttggaactggcactctgcttgctgtccagccaaatatccagaaccctgaccctgccgtgtaccagctgagagact
(SEQ ID NO: 1626)

```
  1: D  Q  Q  V  K  Q  N  S  P  S  L  S  V  Q  E  G  R  I  S  I
     GACCAGCAAGTTAAGCAAAATTCACCATCCCTGAGCGTCCAGGAAGGAAGAATTTCTATT
  1  ----------|----------|----------|----------|----------|----------| 60
     CTGGTCGTTCAATTCGTTTTAAGTGGTAGGGACTCGCAGGTCCTTCCTTCTTAAAGATAA

1: L  N  C  D  Y  T  N  S  M  F  D  Y  F  L  W  Y  K  K  Y  P
     CTGAACTGTGACTATACTAACAGCATGTTTGATTATTTCCTATGGTACAAAAAATACCCT
 61  ----------|----------|----------|----------|----------|----------| 120
     GACTTGACACTGATATGATTGTCGTACAAACTAATAAAGGATACCATGTTTTTATGGGA

1: A  E  G  P  T  F  L  I  S  I  S  S  I  K  D  K  N  E  D  G
     GCTGAAGGTCCTACATTCCTGATATCTATAAGTTCCATTAAGGATAAAAATGAAGATGGA
121  ----------|----------|----------|----------|----------|----------| 180
     CGACTTCCAGGATGTAAGGACTATAGATATTCAAGGTAATTCCTATTTTTACTTCTACCT

1: R  F  T  V  F  L  N  K  S  A  K  R  L  S  L  H  I  V  P  S
     AGATTCACTGTCTTCTTAAACAAAAGTGCCAAGCACCTCTCTCTGCACATTGTGCCCTCC
181  ----------|----------|----------|----------|----------|----------| 240
     TCTAAGTGACAGAAGAATTTGTTTTCACGGTTCGTGGAGAGACGTGTAACACGGGAGG

1: Q  P  G  D  S  A  V  Y  F  C  A  A  S  G  W  G  D  G  G  A
     CAGCCTGGAGACTCTGCAGTGTACTTCTGTGCAGCAAGCGGCTGGGGTGATGGTGGTGCT
241  ----------|----------|----------|----------|----------|----------| 300
     GTCGGACCTCTGAGACGTCACATGAAGACACGTCGTTCGCCGACCCCACTACCACCACGA

1: T  N  K  L  I  F  G  T  G  T  L  L  A  V  Q  P  N  I  Q  N
     ACAAACAAGCTCATCTTTGGAACTGGCACTCTGCTTGCTGTCCAGCCAAATATCCAGAAC
301  ----------|----------|----------|----------|----------|----------| 360
     TGTTTGTTCGAGTAGAAACCTTGACCGTGAGACGAACGACAGGTCGGTTTATAGGTCTTG

1: P  D  P  A  V  Y  Q  L  R  D (SEQ ID NO: 810)
     CCTGACCCTGCCGTGTACCAGCTGAGAGACT (SEQ ID NO: 809)
361  ----------|----------|--------- 391
     GGACTGGGACGGCACATGGTCGACTCTCTGA (SEQ ID NO: 1627)
```

Figure 53:
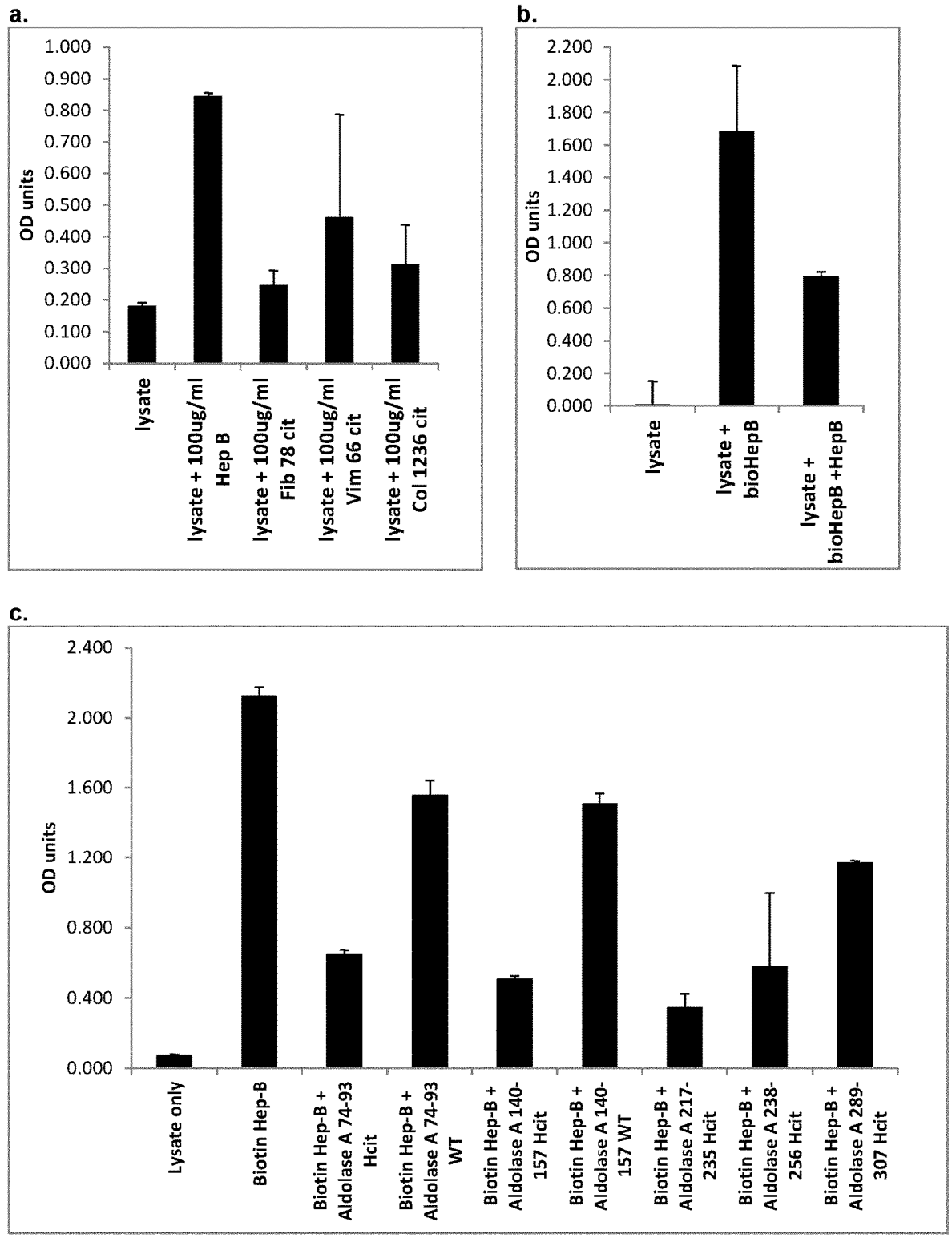

Figure 53 contd
d.
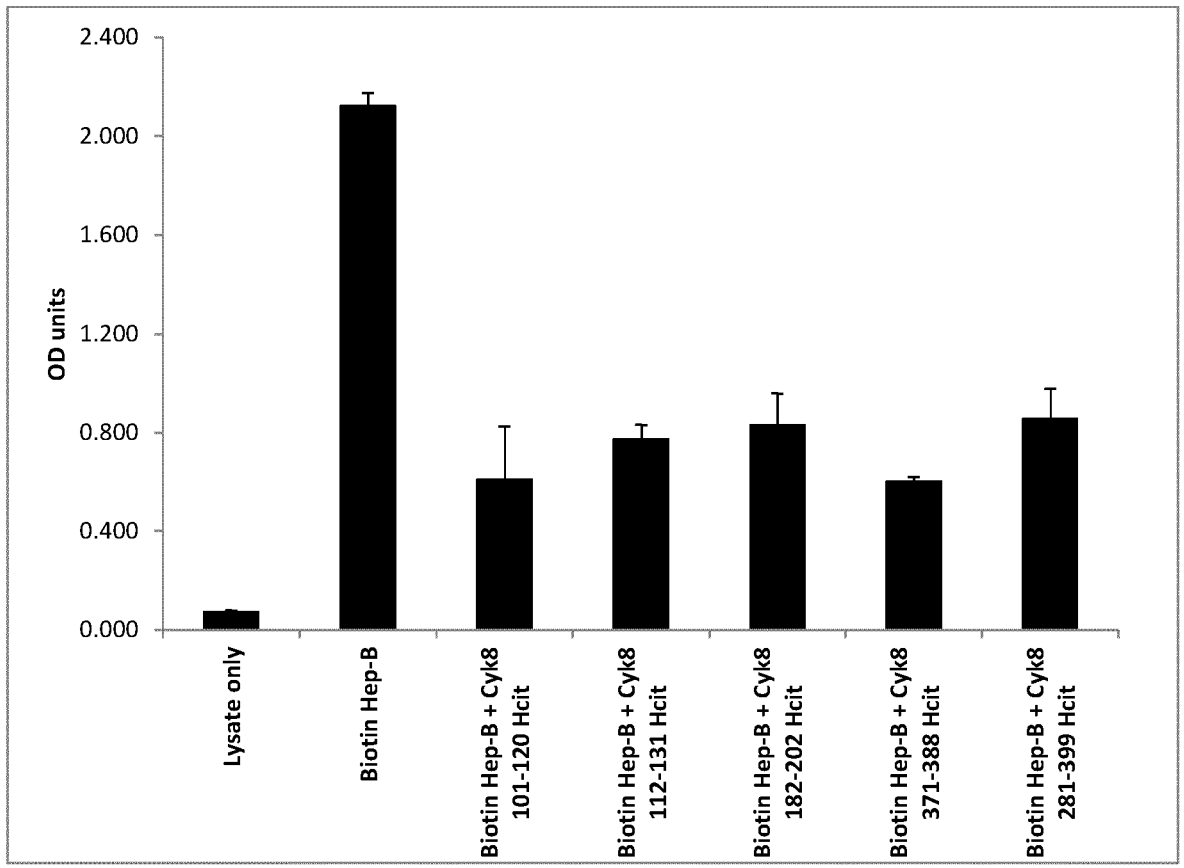
e.
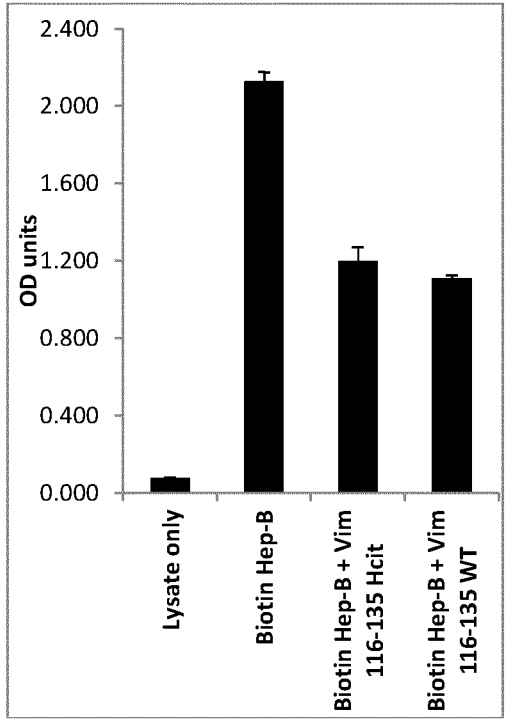

EPITOPES

REFERENCE TO AN ELECTRONIC SEQUENCE LISTING

The contents of the electronic sequence listing (S223970001US00-SUBSEQ-MSB.txt; Size: 750,323 bytes; and Date of Creation: May 26, 2024) is herein incorporated by reference in its entirety.

The present invention relates generally to epitopes, and more particularly to epitopes containing homocitrulline (Hcit) that can be used as targets for cancer immunotherapy. These modified peptides can be used as vaccines or as targets for T cell receptor (TCR) and adoptive T cell transfer therapies.

Lysine can be chemically modified to homocitrulline (Ospelt et al. 2017; Lac et al. 2018) (FIG. 1) in a process known as carbamylation. This reaction occurs when isocyanic acid reacts with the amine (NH2) groups on lysine to yield homocitrulline. The carbamylation of amine groups leads to a change in molecular charge, which in turn alters antigenic properties and can lead to the generation of unique T cell epitopes (Burska et al. 2014; Mydel et al. 2010). Isocyanic acid is in stable equilibrium with cyanate and can be produced from the spontaneous degradation of urea, but under normal physiological conditions the concentration of both urea and cyanate are too low for any significant protein carbamylation. Under inflammatory conditions, carbamylation is predominantly driven by the actions of the myeloperoxidase (MPO) enzyme which, in the presence of hydrogen peroxide, converts thiocyanate to isocyanic acid (Wang et al. 2007; Holzer et al. 2012). MPO is expressed by immune cells including neutrophils, monocytes and macrophages (Eruslanov et al. 2014). Carbamylation has been extensively investigated in the past for its role in renal dysfunction ureamia, and chronic systolic heart failure. However, interest has recently been focused on its role in inflammation and initiation of rheumatoid arthritis (RA) disease (Mydel et al. 2010; Kollipara and Zahedi 2013; Lac et al. 2018; Ospelt et al. 2017). Mice immunised with carbamylated proteins developed arthritis against corresponding antigens. In addition, antibodies against carbamylated protein but not anti-citrullinated protein antibody (ACPA) were detected in mice with collagen-induced arthritis (Stoop et al. 2014; Mydel et al. 2010). Antibodies binding to carbamylated sequences have been found in RA patients; such as Hcit fibrinogen (Scinocca et al. 2014), Hcit collagen (Turunen et al. 2016) and Hcit vimentin (Shi et al. 2011; Turunen et al. 2015). Anti-carbamylated protein antibodies as well as ACPA precede the onset of RA. These findings suggest that carbamylation represents a crucial process in the pathogenesis of RA (Shi et al. 2014). Indeed immunisation of mice with Hcit filaggrin peptides induced strong Hcit-specific B cell responses which led to development of erosive arthritis (Mydel et al. 2010). Pathogenic links with smoking have been related to enhanced MPO-dependent carbamylation of proteins (Wang et al. 2007; Makrygiannakis et al. 2008). Autoantibodies to Hcit vimentin can be detected in 4 out of 6 chronic obstructive pulmonary disease (COPD) smokers or ex-smokers samples (Lugli et al. 2015). This demonstrates that under chronic inflammatory conditions MPO can be activated and carbamylate extracellular proteins or proteins released during apoptosis which are then precipitated and recognised by B cells, resulting in autoantibody production. Against the prevailing view in the art that homocitrullinated peptides are associated with inflammatory responses and autoimmune disease, the inventors have found that certain homocitrullinated peptides cause a T cell response and can be used as targets for cancer immunotherapy, as vaccines or as targets for T cell receptor (TCR) and adoptive T cell transfer therapies.

According to a first aspect of the invention, there is provided a homocitrullinated T cell epitope having (i) a predicted binding score to MHC class II or class I of <30 using the online IEDB prediction program (iedb.org/) and (ii) at least 5 consecutive amino acids that form a spiral conformational structure.

The inventors have unexpectedly found that it is possible to raise T cell response to epitopes from intracellular antigens expressed within viable MPO negative cells in which the lysine has been replaced by homocitrulline. Furthermore, homocitrulline-containing peptides not only permit the development of T cell-based therapies, including but not limited to tumour vaccines, but also TCR and adoptive T cell transfer therapies. This T-cell response contrasts with responses in autoimmune diseases which are driven by autoantibodies which form complexes with extracellular antigens or antigens precipitated from dying cells. These immune complexes interact via their Fc regions with immune cells further driving the pathogenesis of autoimmune diseases. It is also in contrast to WO2014/023957 A2 which discloses that citrullination of proteins which can occur in viable cells by activation of PAD enzymes within the cells and that immune responses can be raised to those citrullinated peptides. The T cell epitope of the present invention may be a MHC class I or MHC class II epitope, i.e. form a complex with and be presented on a MHC class I or MHC class II molecule. The skilled person can determine whether or not a given polypeptide forms a complex with an MHC molecule by determining whether the MHC can be refolded in the presence of the polypeptide. If the polypeptide does not form a complex with MHC then MHC will not refold. Refolding is commonly confirmed using an antibody that recognises MHC in a folded state only. Further details can be found in Garboczi et al., Proc Natl Acad Sci USA. 1992 Apr. 15;89 (8): 3429-33. All of the lysine amino acid residues in the epitope may be converted to homocitrulline. Alternatively, 1, 2, 3 or 4 of the lysine amino acid residues in the epitope may be converted to homocitrulline, with the remainder being unconverted. Thus, an epitope of the present invention may have 1, 2, 3 or 4 homocitrulline residues. Epitopes of the present invention may be up to 25 amino acids in length. They may be at least 5 amino acids in length and may be no longer than 18, 19, 20, 21, 22, 23 or 24 amino acids. The T cell epitope of the present invention may be a self antigen or a tumour-associated antigen and may stimulate an immune response against the tumour.

The inventors have shown that, by employing epitope predictive algorithms to select homocitrullinated epitopes based upon major histocompatibility complex MHC II binding with high predicted affinity to HLA-DR4, DR1 or DP4, there is a repertoire of T cells which recognise homocitrullinated peptides from vimentin (VIME), aldolase (ALDOA), cytokeratin 8 (CyK8 or K2C8), immunoglobulin binding protein (BiP), nucleophosmin (NPM), α-enolase (ENO1or ENOA), β-catenin (CTNNB1) or heat shock protein (HSP60 or CH60) in HLA transgenic mice, ALDOA (Tables 1-4). Interestingly, in this study the inventors have identified CD4 T cell responses to carbamylated vimentin, ALDOA, enolase, BiP, nucleophosmin and cytokeratin 8 peptides restricted through the non SE allele HLA-DP4 as well as the SE allele HLA-DR1, suggesting that carbamylated peptides have broader binding specificity to MHC class II than just the SE alleles. In addition, the inventors also show the identification of CD8 T cell responses to carbamylated aldolase and cytokeratin 8 peptides restricted through the HLA-A2 allele.

Intially peptides were selected based upon predicted high binding scores using the online IEDB prediction program (iedb.org/) and that contained lysine residues within the predicted binding core and then had their lysine residues replaced with Hcit prior to further analysis. Although IEDB was used to predict the binding score of the epitopes, there was not a strong correlation between predicted binding strength and T cell responses, with only 4/10 peptides stimulating a T cell response. This may be due to the IEDB algorithms which do not allow for the inclusion of the modified amino acids. Surprisingly, when peptides containing 5 or more amino acids that spiral were included in the epitope, 100% of the epitopes stimulated a T cell response (Tables 1-4).

Homocitrullinated T cell epitopes of the present invention have a predicted binding score to MHC class II or class I of <30 using the online IEDB prediction program (Version 2.20, Vita, et al., Nucleic Acids Res. 2015 Jan. 28; 43 (Database issue): D405-D412). The selection IEDB Recommended uses the Consensus approach (Wang et al, BMC Bioinformatics. 11:568, 2010; Wang et al, PLOS Comput Biol. 4 (4): e1000048, 2008), combining NN-align, SMM-align, CombLib and Sturniolo if any corresponding predictor is available for the molecule. Otherwise NetMHCIIpan is used. The Consensus approach considers a combination of any three of the four methods, if available, where Sturniolo is a final choice. The expected predictive performances are based on large scale evaluations of the performance of the MHC class II binding predictions: a 2008 study based on over 10,000 binding affinities (Wang et al. 2008), a 2010 study based on over 40,000 binding affinities (Wang et al. 2010) and a 2012 study comparing pan-specific methods (Zhang et al. 2012). Supplementary information for evaluation of predictive tools are available for 2008 and 2010 studies.

The predicted output is given in units of IC50 nM for CombLib and SMM_align. Therefore, a lower number indicates higher affinity. As a rough guideline, peptides with IC50 values <50 nM are considered high affinity, <500 nM intermediate affinity and <5000 nM low affinity. Most known epitopes have high or intermediate affinity, including those of the present invention. Some epitopes have low affinity, but no known T-cell epitope has an IC50 value greater than 5000 nM. For each epitope, a percentile rank for each of the three methods (combinatorial library, SMM_align and Sturniolo) can be generated by comparing the peptide's score against the scores of five million random 15mers selected from SWISSPROT database. The 'predicted binding score' is the percentile rank score.

As an alternative to having a predicted binding score to MHC class II or class I of <30, epitopes of the present invention may have an IC50 of 3000 nM or less, preferably 1000 nM or less and most preferably 500 nm or less. Binding can be determined using the assay set out in Example 9 herein and a skilled person knows how to determine IC50. Binding to MHC-II can be confirmed by competition for binding to known MHC-II binding epitopes such as HepB 181-192. For example, the epitopes Aldolase A 74-93Hcit, Aldolase A 140-157 Hcit, Aldolase A 217-235 Hcit, Aldolase A 238-256 Hcit, Cyk8 101-120 Hcit, Cyk8 112-131 Hcit, Cyk8 182-202 Hcit, Cyk8 371-388 Hcit and Cyk8 281-399 Hcit all showed greater than 60% inhibition of binding HepB to HLA-DP4. Thus, certain peptides of the invention may show at least 50%, 60%, 70% or 80% inhibition of binding HepB to HLA-DP4. Binding to MHC-I can be confirmed by competition for binding to known MHC-I binding epitopes.

Homocitrullinated T cell epitopes of the present invention have at least 5 consecutive amino acids that form a spiral conformational structure, i.e. an alpha helix structure with a minimum of 5aa within the alpha helix region. A person skilled in the art knows a number of techniques for determining whether a sequence of amino acids forms a spiral. For example, the peptide can be crystallised and its structure determined using x-ray crystallography. Alternatively, NMR can be used. In addition, whether amino acids can form a spiral can be predicted using bioinformatic analysis (Alland et al. 2005; Néron et al.

2009) and computer modelling, for example using the online protein folding programme PEP-FOLD3, bioserv.rpbs.univ-paris-diderot.fr/services/PEP-FOLD3/; Lamiable, et al, Nucleic Acids Res. 2016 Jul. 8;44 (W1): W449-54; Shen, et al, J. Chem. Theor. Comput. 2014; 10:4745-4758; Thévenet, et al, Nucleic Acids Res. 2012. 40, W288-293.).

Immunisation of HLA transgenic mice with peptides which fulfil these criteria stimulate strong CD4 or CD8 T cell responses. The inventors have shown for the first time that a repertoire of T cells for Hcit epitopes also exists in healthy donors and cancer patients. Peripheral blood mononuclear cells (PBMCs) were isolated, CD25 cells depleted, labelled with CFSE and proliferation monitored after stimulation with Hcit epitopes. Proliferation was determined from healthy donors and cancer patients, with most donors giving a CD4 T cell response to at least one Hcit epitope.

Immunogenic peptides of the invention are homocitrullinated. All of these peptides (100%) were immunogenic. A high predicted HLA-DP4 binding affinity (<30), the presence of homocitrulline residues in the core region, the peptide being amphipathic in nature with a predominantely spiral conformational structure upon 3D modelling, and the existence of homology between the mouse and human sequences may define immunogenicity. When this model was applied retrospectively to include the vimentin and ALDOA peptides 8/9 (88%) were correctly predicted.

Surprisingly, the inventors have found that certain homocitrullinated epitopes are associated with tumours and consequently can be used to raise an immune response against such tumours. The inventors have identified carbamylation (or homocitrullination), which can occur on specific proteins, including but not restricted to vimentin, ALDOA, cytokeratin 8, immunoglobulin binding protein, nucleophosmin (NPM), α-enolase, β-catenin and HSP60, that leads to strong T cell immunity. Homocitrulline peptide vaccination stimulated specific CD4 and CD8 responses that mediated efficient tumour therapy. As CD4 and CD8 T cells recognise peptides presented by MHC-II and MHC-I molecules respectively, the carbamylated proteins need to be processed and access the MHC class I or class II pathways. This could be within MPO expressing antigen presenting cells which could the present the carbamylated epitopes on MHC-I or MHC-II to activated CD8 or CD4 T cells. These cells could then mediate a bystander anti-tumour effect by releasing cytotoxic cytokines which can have a cytostatic or cytotoxic effect on the tumour cells and/or recruit other immune effectors cell such as CD8 T cells (Hung et al. 1998). If this was the case, then the homocitrulline peptide specific response should work on MHC-II negative tumours as the CD4 T cells would not have to directly recognise the tumour cells. In this study, no anti-tumour response was seen with the homocitrulline peptides against a MHC-II negative tumour. Therefore, tumour therapy was largely dependent upon direct recognition of tumour cells, suggesting the homocitrulline peptides are presented on MHC class II by the tumour cells themselves. This is likely to also be the case for CD8 mediated tumour therapy with direct presentation of homocitrulline peptides by MHC class I on the tumour. This was unexpected as tumour cells do not express MPO so it is not possible for the tumour cells themselves to convert lysine to homocitrulline. Conversion must rely on infiltrating cells producing isocyanic acid which diffuses into the tumour cells and results in carbamylation. Staining of tumour cells grown in vitro and in vivo for the expression of MPO revealed that B16 tumour cells do not express this enzyme. Expression of MPO in vivo is mostly restricted to subsets of neutrophils, macrophages and monocytes which are thought to be responsible for the inflammation driven carbamylation of proteins (Wang et al. 2007; Cedervall, Hamidi, and Olsson 2018). Staining data confirms this with MPO expression being detected in CD11b+ cells, a marker expressed by neutrophils, granulocytes, macrophages and monocytes, in both tumours and spleen. Further analysis of MPO expressing cells in the tumour environment shows that the MPO-expressing CD11b+ cells are divided into a subset expressing high levels of Ly6C and no Ly6G or a subset that is Ly6G+ expressing lower levels of Ly6C. These markers have been defined as distinguishing populations of monocytic and granulocytic myeloid derived suppressor cells (MDSC) respectively (Youn et al. 2012; Zhao et al. 2016). Depletion studies revealed that removal of the Ly6G+ fraction has little effect upon tumour growth but in combination with peptide vaccination it appeared to have a small effect upon tumour therapy suggesting perhaps a small role for the Ly6G+ cells as the source of MPO for the carbamylation of proteins in the tumour environment. Depletion of the Ly6C+ cells had a more profound effect upon tumour growth providing a significant therapeutic tumour effect as a stand-alone treatment. Combination of the Ly6C depletion with peptide vaccination significantly reduced the therapeutic anti-tumour effect seen with the peptide vaccine to the level seen with antibody depletion alone. This suggested a role for the Ly6C+ cell fraction, in particular the Ly6C high cells, as the source of MPO responsible for carbamylation in tumours. Comparison of carbamylated protein levels between wild type mice and MPO-knock out mice after the induction of acute inflammation showed a significantly increased level in wild type mice suggesting MPO has a major role in protein carbamylation in vivo (Kollipara and Zahedi 2013). Interestingly, MPO production in the tumour was associated with Ly6C+ cells whereas in the spleen this cell population does not appear to produce MPO suggesting some tissue specificity. In a number of cancers MPO expression within infiltrating cells has been identified and linked to a poor prognosis (Castillo-Tong et al. 2014; Droeser et al. 2013). Due to oncogenic transformation, cancer cells display high levels of hydrogen peroxide, which is often also associated with antioxidant imbalances (Benfeitas et al. 2017). This results in damage to nuclear and mitochondrial DNA which in turn, promotes hydrogen peroxide generation, thereby resulting in a vicious cycle of hydrogen peroxide production. The combination of MPO from immune infiltrates and hydrogen peroxide from tumour cells results in the production of isocyanic acid which can then diffuse across the cell membrane and induce carbamylation of cytoplasmic proteins within tumour cells (Roberts et al. 2011). Interestingly, smokers have increased serum thiocyanate levels which are thought to drive increased carbamylation and increase the risk of some autoimmune diseases but could also be a target for cancer vaccines (Martinez et al. 2016; Ospelt et al. 2017). It remains to be shown if the hydrogen peroxide is produced by the tumours or MDSC but we have shown that potassium cyanate can diffuse into tumour cells and result in carbamylation of proteins. The inventors have demonstrated herein that MDSCs can drive carbamylation of tumour proteins in vitro supporting the role for MDSC mediated carbamylation in tumours. Then, like citrullinated proteins, carbamylated proteins could be digested during autophagy and presented on MHC-II (Brentville et al. 2016). Carbamylated proteins could also be cross presented to the MHC-I presentation pathway for presentation on MHC-I. The MHC class II antigen processing pathway can be influenced by many factors, such as the internalisation and processing of exogenous antigen, the peptide binding motif for each MHC class II molecule and the transportation and stability of MHC class II: peptide complex. The MHC class II peptide binding groove is open at both ends and it is less constrained by the length of the peptide compared to MHC Class I molecules. The peptides that bind to MHC class II molecules range in length from 13-25 amino acids long and typically protrude out of the MHC molecule (Kim et al. 2014; Sette et al. 1989). These peptides contain a consecutive stretch of nine amino acids, referred to as the core region. Some of these amino acids interact directly with the peptide binding groove (Andreatta et al. 2017). The amino acids either side of the core peptide protrude out of the peptide binding groove; these are known as peptide flanking regions. They can also impact peptide binding and subsequent interactions with T cells (Arnold et al. 2002; Carson et al. 1997; Godkin et al. 2001). The length of MHC class II peptides allows long peptides, e.g. 15-20mers, to be used in screening. For example, to cover vimentin, if every peptide was screened, this would require 429 peptides. However, due to the central binding core region, 15mers offset by 4 amino acids or 20mers offset by 5, can be used. For example, in vimentin, this would require 114×15mer overlapping peptides; these cover the full 466 amino acids and overlap by 11 amino acids. Alternatively, if 20mers overlapping by 15 were used, it would require 91×20mer peptides. Of these, 60 peptides contain a lysine residue. To screen 60 peptides, these would be combined into smaller peptide pools and incorporated into an in vitro assay or used in in vivo murine immunisation studies. This type of screening is standard in designing neoepitope personalised vaccines to screen hundreds of peptides. For example, Liu et al. examined responses to neoanitgens in epithelial ovarian cancer patients (Liu et al. 2019). They screened 75 peptides and found 27 that stimulated T cell responses. Bobisse et al. screened 776 peptides and and found 15 (2%) that stimulated T cell responses (Bobisse et al. 2018).

This method is also a viable approach to identify MHC class I peptides as longer 20mer peptides also can contain nested MHCI restricted epitopes, and has been used to identify both MHCII and MHCI restricted CD4 and CD8 responses. Given the use of such methodology for identifying cancer vaccine neoantigen targets for individual cancer patients, it is an equally viable and justifiable approach for single antigens in order to develop a vaccine to treat a wide range of cancer patients whose tumour expresses the citrullinated antigen. This would require testing in multiple donors to ensure epitopes binding to different MHC-II and MHC-I molecules are identified. The same 114×15mer or 91×20mer overlapping peptides would be used either individually or in pools in each donor.

MHC class II molecules are highly polymorphic, the peptide binding motifs are highly degenerate with many promiscuous peptides having been identified that can bind multiple MHC class II molecules (Consogno et al. 2003). The amino acids that are critical for peptide binding have been identified from crystallography studies of MHC class II: peptide complexes (Corper et al. 2000; Dessen et al. 1997; Fremont et al. 1996; Ghosh et al. 1995; Latek et al. 2000; Li et al. 2000; Lee, Wucherpfennig, and Wiley 2001; Brown et al. 1993; Smith et al. 1998; Stern et al. 1994; Scott et al. 1998; Fremont et al. 1998). These studies have indicated that P1, P4, P6 and P9 always point towards the MHC whereas P-1, P2, P5 P8 and P11 always orient towards the TCR. The peptide binding motifs for the most frequent HLA-DR alleles in the UK population is shown in FIG. 2a, and the frequency of these HLA alleles is listed in Table 1 (Thomsen and Nielsen 2012). The HLA DR motifs show a preference for particular amino acids at the anchor positions (P1, P4, P6 and P9) across different HLA-DR alleles, this is irrespective of the source of peptide (Barra et al. 2018). From the motifs shown in FIG. 2a, it can be seen that lysine to not a good anchor residue and rarely present in P1, P4, P6 and P9. In contrast, lysine tends to be present at P2, P5 and P8. These positions always orientate towards the TCR and are likely to be important in the MHC: TCR interaction.

TABLE 1

HLA-DR allele frequency in the UK population

| Allele | % individuals that have the allele | Sample Size |
|---|---|---|
| DRB1*04 | 32 | 57,732 |
| DRB1*03 | 28 | 57,732 |
| DRB1*07 | 28 | 57,732 |
| DRB1*15 | 28 | 57,732 |
| DBR1*01 | 22 | 57,732 |

In contrast, MHC class I molecules show more restricted peptide binding properties. Amino acids critical for binding to MHC class I have also been identified through prediction algorithms analysing known naturally binding peptides (Jurtz et al. 2017), which indicated that (with the exception of HLA-B*0801) P2 and P9 orient towards the MHC acting as binding anchor residues. The peptide binding motifs for common HLA alleles in the UK population is shown in FIGS. 2b and c. From the motifs shown in FIGS. 2b and c, it can be seen that lysine is not a good anchor residue and rarely present in P2 or P9 (with exception of HLA A*0301). In contrast, lysine can be present at other position which are likely to be important in the MHC: TCR interaction. This suggests that changing lysine to homocitrulline would change the T cell repertoire being recognised.

The epitope of the present invention may be from a cytoplasmic protein. Cytoplasmic proteins that can be carbamylated and are commonly expressed in tumours are aldolase A (FIGS. 3*a* and *b*), vimentin (FIG. 3*c*), cytokeratin 8 (FIG. 3*d*), BiP (FIG. 3*e*), nucleophosmin (: FIG. 3*f*), α-enolase (FIG. 3*g*), β-catenin (FIG. 3*h*) and HSP60 (FIG. 3*i*). The epitope of the present invention may be from any one of these proteins.

In cancer cells vimentin is important in the reorganisation of the cytoskeleton during EMT) (Liu et al. 2015; Polioudaki et al. 2015). During EMT epithelial cell markers are down regulated and mesenchymal markers such as vimentin are upregulated which leads to increased proliferation and metastasis. Vimentin is a poor prognostic marker in triple-negative breast cancer, gastric cancer and non-small cell lung cancer (NSCLC) among others (Otsuki et al. 2011; Yamashita et al. 2013; Tadokoro et al. 2016). Accumulating evidence suggests an involvement of homocitrullinated vimentin and anti-homocitrullinated vimentin antibodies in the pathogenesis of RA (Ospelt et al. 2017). Vimentin is a major and well characterised autoantigen in RA. The vimentin network that extends from the nucleus to the plasma membrane is believed to act as a scaffold, providing cellular mechanostructural support and thereby maintaining cell and tissue integrity (Lundkvist et al. 2004). More recently antibodies recognising homocitrullination of vimentin have been described and also show vimentin can form its own class of carbamylated antigens which could be recognised in an modification specific manner in animal models (Ospelt et al. 2017). We are the first to show homocitrullinated vimentin peptides lead to strong immune T cell responses and anti-tumour immunity.

Aldolase is a glycolytic protein which has been shown to carry out a number of additional function including interacting with cytoskeletal proteins. Like vimentin, aldolase, which is a glycolytic enzyme found in the cytoplasm, can be homocitrullinated. In mammals, there are three isoforms (A, B and C) of the aldolase enzyme which are encoded by three distinct genes. The three human aldolase isozymes are similar in sequence with 66% identity between human A and B, 68% identity between B and C, and 78% identity between A and C (FIG. 3*a*). The ALDOA gene encodes fructose-biosphosphate aldolase A that catalyses the reversible conversion of fructose-1, 6-biosphosphate to glyceraldehyde-3-phosphate and dihydroxyacetone phosphate which is expressed in the muscle and brain of embryos. ALDOA is highly expressed in a number of cancers including lung squamous cell carcinoma (LSCC) and adrenocortical tumours (Du et al. 2014; Kjellin et al. 2014). Upregulation of ALDOA has been linked to poor prognosis in colon cancer, renal cell carcinoma and colorectal cancer (Dai et al. 2018; Huang et al. 2018; Ye et al. 2018). Silencing ALDOA expression reduced cell proliferation, migration, invasion and EMT phenotype of cancer cell lines suggesting it could be an important target for therapies. Aldolase B (ALDOB) is preferentially expressed in the liver, kidney, and in enterocytes, and aldolase C (ALDOC) is expressed in the brain. Cancer cells, the proliferation of which is regulated by hypoxic conditions, oncogenic signals and the Myc oncoprotein, enhance glycolysis which leads to increased glycolytic enzyme expression in tumour cells. Hypoxia in the tumour microenvironment is a major factor during growth of solid tumour. Therefore, upregulation of glycolytic enzymes is necessary for tumour survival. The AldoA promoter contains a hypoxia responsive element which is upregulated in cells in response to hypoxic stress (Semenza et al. 1996). In LSCC, upregulation of ALDOA is associated with metastasis and poor prognosis while its depletion reduces the capabilities of tumour cell motility and tumorigenesis (Du et al. 2014). In addition to glycolytic function, there are other potential mechanisms that ALDOA might be involved with in carcinogensis. It has been suggested ALDOA serves a key role in cell cycle regulation. ALDOA silencing inhibited cancer cell proliferation and this did not interfere with cellular energy metabolism, suggesting it is not linked to glycolytic function (Ritterson Lew and Tolan 2012). Evidence also exists that ALDOA regulates cancer cell proliferation in association with MKI67 (proliferation marker) (Ritterson Lew and Tolan 2012) and MELK (cell cycle dependant protein kinase) (Zhang et al. 2017). Together these functions suggest ALDOA plays an active role in tumour growth and metastasis. ALDOA has been shown highly expressed in a variety of malignant cancer, including lung cancer (Du et al. 2014), osteosarcoma (Chen et al. 2014), colorectal cancer (Peng et al. 2012), oral squamous cell carcinomas (Lessa et al. 2013), adrenocortical tumours (Kjellin et al. 2014) and hepatocellular carcinomas (Hamaguchi et al. 2008). Since ALDOA could be significantly elevated in solid tumours such as non-small cell lung cancer, cervical cancer, breast cancer and hepatocellular carcinoma, elevated ALDOA expression could serve as a diagnostic and prognostic marker for these cancers (Zhang et al. 2017). In RA patients, ALDOA has been shown to be an autoantigen (Goeb et al. 2009).

Two-dimensional gel and mass spectrometry identified ALDOA peptides can be citrullinated from sera of early RA patients (RLQSIGTENTEENR (SEQ ID NO: 1) and KDGADFAKWRRCVLK (SEQ ID NO: 2)) (Goeb et al. 2009). Citrullinated ALDOA has also been shown in prion disease (Jang et al. 2008; Jang et al. 2010). However, there is no evidence so far on carbamylation of ALDOA. We are the first to show carbamylation of ALDOA and homocitrullinated peptides which lead to strong immune responses and anti-tumour immunity. No anti-carbamylated T or B cells responses to ALDOA have been reported. We are the first to show carbamylation of ALDOA and homocitrullinated peptides lead to strong immune responses and anti-tumour immunity.

Keratins are the largest family of intermediate filament proteins which have wide tissue distribution, multiple functions and disease associations (Chou, Skalli, and Goldman 1997; Chang et al. 2013). They play important roles in maintaining shapes and rigidity of the cells by forming cytoplasmic scaffold that emanates from the plasma membrane (Fuchs and Cleveland 1998). In addition to structural functions, they are also involved in signalling pathways that regulate cell cycle progression, apoptosis, cellular response to stress, protein synthesis, cell size and membrane trafficking (Paramio and Jorcano 2002; Coulombe and Omary 2002; Oshima 2002). Keratin 8 (previously known as Cytokeratin 8: Cyk8) polymerizes with Keratin 18 and this keratin pair is the first to be expressed in embryogenesis. In adult tissues, the expression of this pair is restricted to simple (such as liver, pancreas, kidney) and mixed (such as breast, lung) epithelia (Moll et al. 1982; Owens and Lane 2003; Franke et al. 1981; Blobel et al. 1984). Over-expression of this pair has been observed in adenocarcinomas and squamous cell carcinomas (Oshima, Baribault, and Caulin 1996; Vaidya et al. 1989). It has been reported that keratin 8 and 18 expression along with vimentin results in increase in drug resistance, invasion and metastasis in breast cell carcinomas and melanomas (Thomas et al. 1999). Aberrant expression of Cyk8 is found in non-small-cell lung cancer and also present in the sera of patients with NSCLC (Fukunaga et al. 2002). Autoantibodies of Cyk8 has been found in patients with RA and described as one of the real antigens of the so called anti-keratin antibodies associated with RA (Wang et al. 2015). No anti-carbamylated T or B cells responses to Cyk8 have been reported. We are the first to show homocitrullinated Cyk8 peptides induce strong T cell responses and anti-tumour immunity.

Binding immunoglobulin protein (BiP)/glucose regulated protein 78 (GRP78)/heat shock protein (5a (HSP5a) is a member of the HSP70 and the relative molecular weight of BiP range from 72 to 83 kDa (Blass et al. 2001). In mammalian, BiP is commonly found in the ER lumen, functions as the key regulator of the unfolded protein response (UPR) (Lewy, Grabowski, and Bloom 2017). BiP halts the accumulation of unfolded proteins in cells by interacting with exposed hydrophobic residues on nascent peptides (Dorner, Wasley, and Kaufman 1992). In addition to ER, evidence is emerging that BiP can also be found in cytoplasm, mitochondria, nucleus as well as on cell surface (Lee 2014; Luo and Lee 2013; Ni, Zhang, and Lee 2011). BiP has been discovered to be preferably expressed on the surface of stressed cancer cells, where it is involved in the regulation of critical oncogenic signalling pathways. The expression of BiP on cancer cell surface is actively enhanced by ER stress (Arap et al.

2004; Gonzalez-Gronow et al. 2009; Zhang et al. 2010). BiP has also been detected on the cell surface of some tumour initiating cells (TICs), elevated level in metastatic and chemoresistance cancer cells, and hypoxic endothelial cells that support tumour cells (Arap et al. 2004; Gonzalez-Gronow et al. 2009; Lee 2014). Anti-BiP antibodies have been identified and isolated from cancer patients. An anti-BiP IgG antibody binds to N-terminal region of BiP, which was isolated from the serum of prostate cancer patients enhances cell survival and proliferation (Gonzalez-Gronow et al. 2006). A human anti-BiP mAb recognises the last 20 amino acid residues of the C-terminal region has no effect on cell proliferation and does not induce apoptosis (Jakobsen et al. 2007). The detection of anti-citrullinated BiP (anti-citBiP) antibodies in the serum of RA patients was reported (Shoda et al. 2011). No anti-carbamylated T or B cells responses to Bip have been reported. We are the first to show that anti-carbamylated T cell responses can be stimulated to BiP and these can mediate tumour therapy.

Nucleophosmin is a nucleolar/cytoplasmic protein that plays a variety of roles in cellular metabolism including ribosome biogenesis, mRNA processing and chromatin remodelling (Box et al. 2016). Overexpression of NPM has been reported in multiple human cancers including those of the pancreas (Zhu et al. 2015), prostate (Leotoing et al. 2008), liver (Yun et al. 2007), colon (Nozawa et al. 1996), stomach (Tanaka et al. 1992), thyroid (Pianta et al. 2010) and in glioblastoma (Holmberg Olausson et al. 2015). Furthermore, in some cancers such as bladder carcinoma, the progression of the disease to an advance stage also correlates with NPM expression (Tsui et al. 2004). NPM has also been implicated in chromosomal translocations in acute myeloid leukaemia and non-Hodgkin lymphomas. In 35% of AML patients, NPM is mutated and aberrantly located in the cytoplasm of leukemic cells (Falini et al. 2005). The AML patients have a normal karyotype and the NPM shift to the cytoplasm is due to a mutation in exon 12 (Falini et al. 2005). Although NPM undergoes a number of post-translational modifications including ubiquitination, sumoylation, phosphorylation, poly-(ADP-ribosyl) ation and citrullination (Hagiwara et al. 2002; Tanikawa et al. 2009). No anti-carbamylated T or B cells responses to NPM have been reported. We are the first to show that anti-carbamylated T cell responses can be stimulated to NPM and these can mediate tumour therapy.

α-enolase is a glycolytic enzyme catalyzing the penultimate step in glycolysis (Miles et al. 1991). Many tumors switch to generating their energy via glycolysis even under normoxic conditions in a process termed the "Warburg effect". As such ENO1 is overexpressed in a wide range of tumors (Zhao et al. 2015; Cappello et al. 2009; Fu et al. 2015; Principe et al. 2015). Due to its ubiquitous expression and abundance in most cells, ENO1 is also degraded during autophagy. Previous studies have shown that ENO1 can also be citrullinated (Lundberg et al. 2008; Gerstner et al. 2016). No anti-carbamylated T or B cells responses to ENO1 have been reported. We are the first to show that anti-carbamylated T cell responses can be stimulated to ENO1 and these can mediate tumour therapy βCatenin is a proto-oncogene and an important part of the WNT pathway (Moon et al. 2002). Mutations of this gene are commonly found in a variety of cancers: in primary hepatocellular carcinoma, colorectal cancer, ovarian carcinoma, breast cancer, lung cancer and glioblastoma. It has been estimated that approximately 10% of all tissue samples sequenced from all cancers display mutations in the CTNNB1 gene. Most of these mutations cluster on a tiny area of the N-terminal segment of β-catenin: the β-TrCP binding motif. Loss-of-function mutations of this motif essentially make ubiquitinylation and degradation of βCatenin impossible. It will cause β-Catenin into translocate to the nucleus without any external stimulus and continuously drive transcription of its target genes (Gay et al. 2015). WNT family members have been identified both as driving factors and potential therapeutic targets in rheumatoid arthritis (Miao et al. 2013). Increased nuclear Beta-Catenin levels have also been noted in basal cell carcinoma (BCC) head and neck squamous cell carcinoma (HNSCC), prostate cancer (CaP), pilomatrixoma (PTR) and medulloblastoma (MDB). These observations may or may not implicate a mutation in the β-Catenin gene: other WNT pathway components can also be faulty. Similar mutations are also frequently seen in the β-Catenin recruiting motifs of adenomatous polyposis coli (APC) gene. Hereditary loss-of-function mutations of APC cause a condition known as Familial Adenomatous Polyposis. Affected individuals develop hundreds of polyps in their large intestine. Most of these polyps are benign in nature, but they have the potential to transform into deadly cancer as time progresses. Somatic mutations of APC in colorectal cancer are also not uncommon. Aberrantβ-Catenin expression in breast cancer is associated with the triple-negative phenotype (Geyer et al. 2011). β-catenin and APC are among the key genes (together with others, like K-Ras and SMAD4) involved in colorectal cancer development. The potential of β-Catenin to change the previously epithelial phenotype of affected cells into an invasive, mesenchyme-like type contributes greatly to metastasis formation. No anti-carbamylated T or B cells responses to β-Catenin have been reported.

HSP60 is a molecular chaperone known to assist protein folding in prokaryotes and in eukaryotic cell organelles. HSP60 in eukaryotes is considered typically a mitochondrial chaperone (also called Cpn60) but in the last few years it has become clear that it also occurs in the cytosol, the cell surface, the extracellular space and in the peripheral blood (Cappello et al. 2008). High expression of HSP60 has been noted in a number of cancers and HSP60 seems to have potential in the areas of diagnosis-prognosis, and prevention and treatment of various human cancers (Saini and Sharma 2017). It favours the survival of certain types of tumour cells, and in some cases it may even be essential for tumour-cell growth. Tumour immunogenicity may also depend on whether tumour cells express and secrete HSP60 or not (Feng et al. 2001; Lv et al. 2012). The presence of citrullinated HSP60 in rheumatoid arthritis and tumour cell lines have been reported recently (Lu et al. 2016; Jiang et al. 2013). B16DP4 tumours were also lysed and analysed by mass spectroscopy for carbamylation of HSP60. Residues K191, K202, K205, K218, K222, K359, K481 and K58 were all carbamylated. To date there is no evidence of carbamylated HSP60. However, we provide the first evidence of the presence of homocitrulline residues in murine tumour samples.

The T cell epitope of the present invention may comprise, consist essentially of, or consist of i) one or more of the following amino acid sequences wherein one or more-preferably all-of the lysine (K) residues is replaced with homocitrulline:

```
                                          (SEQ ID NO: 3)
NYIDKVRFLEQQNKILLAEL (Vimentin 116-135)

(SEQ ID NO: 4)
LARLDLERKVESLQEEIAFLK (Vimentin 215-235)

(SEQ ID NO: 5)
QIDVDVSKPDLTAALRDVRQQ (Vimentin 255-275)

(SEQ ID NO: 6)
EAEEWYKSKFADLSEAAN (Vimentin 286-303)

(SEQ ID NO: 7)
LPLVDTHSKRTLLKTVETRDGQV (Vimentin 431-454)

(SEQ ID NO: 8)
FKNTRTNEKVELQELNDRFA   (Vimentin 96-115)

(SEQ ID NO: 9)
TNEKVELQELNDRFANYIDKVR (Vimentin 101-122)

(SEQ ID NO: 10)
KVRFLEQQNKLLAE (Vimentin 120-134)

(SEQ ID NO: 11)
DVRQQYESVAAKNLQEAE (Vimentin 271-288)

(SEQ ID NO: 12)
EAEEWYKSKFADLSEAANRN (Vimentin 286-305)

(SEQ ID NO: 13)
FSLADAINTEFKNTRTNEKVELQ (Vimentin 86-108)

(SEQ ID NO: 14)
KMALDIEIATYRKLLEGEE   (Vimentin 390-408)

(SEQ ID NO: 15)
IGGVILFHETLYQKADDGRP (Aldolase 74-93)

(SEQ ID NO: 16)
KDGADFAKWRCVLKIGEH (Aldolase 140-157)

(SEQ ID NO: 17)
LSDHHIYLEGTLLKPNMVT (Aldolase 217-235)

(SEQ ID NO: 18)
HACTQKFSHEEIAMATVTA   (Aldolase 238-256)

(SEQ ID NO: 19)
KCPLLKPWALTFSYGRALQ (Aldolase 289-307)

(SEQ ID NO: 20)
DLKRCQYVTEKVLAAVYKA (Aldolase 198-216)

(SEQ ID NO: 21)
AAQEEYVKRALANSLACQGK (Aldolase 323-342)

(SEQ ID NO: 22)
KVLAAVYKALSDHHIYLEG (Aldolase 208-226)

(SEQ ID NO: 23)
YVTEKVLAAVYKALSD (Aldolase 204-219)

(SEQ ID NO: 24)
VLAAVYKAL (Aldolase 209-217)

(SEQ ID NO: 25)
KFASFIDKVRFLEQQNKMLE (Cytokeratin 8 101-120)
```

-continued

LEQQNKMLETKWSLLQQQKT (Cytokeratin 8 112-131) (SEQ ID NO: 26)

KMLETKWSL (Cytokeratin 8 117-125) (SEQ ID NO: 27)

EINKRTEMENEFVLIKKDVDE (Cytokeratin 8 182-202) (SEQ ID NO: 28)

LREYQELMNVKLALDIEI (Cytokeratin 8 371-388) (SEQ ID NO: 29)

KLALDIE1ATYRKLLEGEE (Cytokeratin 8 381-399) (SEQ ID NO: 30)

ETKVVSLLQQQKTARSNMDNMF (Cytokeratin 8 120-140) (SEQ ID NO: 31)

EQIKSLNNKFASFIDKVREL (Cytokeratin 8 93-112) (SEQ ID NO: 32)

ENEFVUKKDVDEAYMNKV (Cytokeratin 8 190-208) (SEQ ID NO: 33)

GKHGDDLRRIKTEISEM (Cytokeratin 8 294-310) (SEQ ID NO: 34)

RCILREYQELMNVKLALEI (Cytokeratin 8 369-388) (SEQ ID NO: 35)

DEGLKGCRASLEAAIADA (Cytokeratin 8 320-338) (SEQ ID NO: 36)

EQRGELAKDANAKLSELEA (Cytokeratin 8 339-358) (SEQ ID NO: 37)

NDPSVQQDIKFLPFKVVEKKT (BiP 104-124) (SEQ ID NO: 38)

EISAMVLTKMKETAEA (BiP 144-159) (SEQ ID NO: 39)

GEDFDQRVMEHFIKLYKKKTG (BiP 255-275) (SEQ ID NO: 40)

QKLRREVEKAKRALSSQHQAR (BiP 286-396) (SEQ ID NO: 41)

EDFSETLTRAKFEELNMDLFR (BiP 316-336) (SEQ ID NO: 42)

EELNMDLFRSTMKPVQKVL (BiP 328-346) (SEQ ID NO: 43)

RIPKIQQLVKEFFNGKEPSRG (BiP 367-387) (SEQ ID NO: 44)

TVTIKVYEGERPLTKDNHLLG (BiP 460-480) (SEQ ID NO: 45)

RNELESYAYSLKNQIGDK (BiP 562-579) (SEQ ID NO: 46)

KKELEENDPIISKLYGSAG (BiP 620-639) (SEQ ID NO: 47)

PLRPQNYLFGCELKADK (NPM 11-27) (SEQ ID NO: 48)

EGSPIKVTLATLKMSVQPTVSL (NPM 68-89) (SEQ ID NO: 49)

EEEDVKLLSISGKRSAPGGGS (NPM 129-149) (SEQ ID NO: 50)

SKGQESFKKQEKTPKTPKG (NPM 222-240) (SEQ ID NO: 51)

GGSLPKVEAKFINYVKNCFR (NPM 258-277) (SEQ ID NO: 52)

-continued

AKFINYVKNCFRMTDQEAIQDL (NPM 266-287) (SEQ ID NO: 53)

MSILKIHAREIFDSRG (Alpha enolase 1-16) (SEQ ID NO: 54)

NDKTRYMGKGVSKAVEHI (Alpha enolase 52-69) (SEQ ID NO: 55)

TENKSKFGANAILGVSLAVCKA (Alpha enolase 100-121) (SEQ ID NO: 56)

GSHAGNKLAMQEFMILPVGAA (Alpha enolase 156-176) (SEQ ID NO: 57)

REAMRIGAEVYHNLKNVIK (Alpha enolase 179-197) (SEQ ID NO: 58)

NVIKEKYGKDATNVGDEGG (Alpha enolase 194-212) (SEQ ID NO: 59)

DVAASEFFRSGKYDLDFKSP (Alpha enolase 245-264) (SEQ ID NO: 60)

PDQLADLYKSFIKDYPVVS (Alpha enolase 273-291) (SEQ ID NO: 61)

INGAVVQKFTASAGIQVVG (Alpha enolase 301-317) (SEQ ID NO: 62)

NKSCNCLEIKVNQIGSVTE (Alpha enolase 333-352) (SEQ ID NO: 63)

RSERLAKYNQLLRIEEELGS (Alpha enolase 400-419) (SEQ ID NO: 64)

GSKAKFAGRNFRNFLAK (Alpha enolase 418-434) (SEQ ID NO: 65)

EPSCWILKHAVVNLINYQD (Beta-Catenin 127-144) (SEQ ID NO: 66)

EKLLINTISRVIAVLSVCSSNK (Beta-Catenin 334-354) (SEQ ID NO: 67)

TLHNLLLHOEGAKMAVRL (Beta-Catenin 258-275) (SEQ ID NO: 68)

AKMAVRLAGGLQKMVALLNK (Beta-Catenin 269-288) (SEQ ID NO: 69)

KINVKFLAITTDCLQILAYG (Beta-Cateln 288-307) (SEQ ID NO: 70)

TYEKLLVVTTSRVLKVLSV (Beta-Caten in 332-349) (SEQ ID NO: 71)

ISMILKVLSVCSSNKPAIV (Beta-Catenin 340-358) (SEQ ID NO: 72)

YGLPVVVKLLHPFSHVVPL (Beta-Catenin 489-506) (SEQ ID NO: 73)

HVVPUKATVGLIRNLALCPA (Beta-Catenin 503-522) (SEQ ID NO: 74)

IENIQRVAAGVLCELAQDK (Beta-Catenin 607-625) (SEQ ID NO: 75)

GVATYAAAVLFRMSEDKP (Beta-Catenin 650-667) (SEQ ID NO: 76)

IDLKDKYKNIGAKLVQDVAN (HSP60 84-103) (SEQ ID NO: 77)

TVLARSIAKEGFEKISKGAN (HSP60 117-136) (SEQ ID NO: 78)

GEALSTLVLNRLKVGLQVVA (HSP60 280-299) (SEQ ID NO: 79)

```
                                        (SEQ ID NO: 80)
TTSEYEKEKLNERLAKLS (HSP60 381-398)

(SEQ ID NO: 81)
GIIDPTVKVRTALLDAAGVA (HSP60 517-536),
``` or ii) one or more of the amino acid sequences of i), with the exception of 1, 2 or 3 amino acid substitutions, and/or 1, 2 or 3 amino acid insertions, and/or 1, 2 or 3 amino acid deletions in a non-lysine position. The antigen may have a total of 1, 2, 3, 4 or 5 amino acid modifications selected from substitutions, insertions and substitutions in a non-lysine position.

It is preferred if the T cell antigen of the present invention comprises, consists essentially of, or consists of i) one or more of the following amino acid sequences wherein one or more—preferably all—of the lysine (K) residues is replaced with homocitrulline:

```
                                        (SEQ ID NO: 3)
NYIDKVRFLEQQNKILLAEL (Vimentin 116-135)

(SEQ ID NO: 11)
DVRQQYESVAAKNLQEAE (Vimentin 271-288)

(SEQ ID NO: 12)
EAEEWYKSKFADLSEAANRN (Vimentin 286-305)

(SEQ ID NO: 15)
IGGVILFHETLYQKADDGRP (ALDOA 74-93)

(SEQ ID NO: 16)
KDGADFAKWRCVLKIGEH (ALDOA 140-157)

(SEQ ID NO: 18)
HACTQKFSHEEIAMATVTA (ALDOA 238-256)

(SEQ ID NO: 25)
KFASFIDKVRFLEQQNKMLE (Cytokeratin 8 101-120)

(SEQ ID NO: 26)
LEQQNKMLETKWSLLQQQKT (Cytokeratin 8 112-131)

(SEQ ID NO: 27)
KMLETKWSL (Cytokeratin 8 117-125)

(SEQ ID NO: 28)
EINKRTEMENEFVLIKKDVDE (Cytokeratin 8 182-202)

(SEQ ID NO: 29)
LREYQELMNVKLALDIEI (Cytokeratin 8 371-388)

(SEQ ID NO: 30)
KLALDIDATYRKLLEGEE (Cytokeralin 8 381-399)

(SEQ ID NO: 13)
FSLADAINTEFKNTRTNEKVELQ (Vimentin 86-108 Hcit)

(SEQ ID NO: 14)
KMALDIEIATYRKLLEGEE (Vimentin 390-408 Hcit)

(SEQ ID NO: 23)
YVTEKVLAAVYKALSD (Aldolase 204-219 Hcit)

(SEQ ID NO: 24)
VLAAVYKAL (Aldolase 209-217Hcit)

(SEQ ID NO: 20)
DLKRCQYVTEKVLAAVYKA (Aldolase 198-216 Hcit)

(SEQ ID NO: 42)
EDFSETLTRAKFEELNMDLFR (BiP 316-336 Hcit)

(SEQ ID NO: 43)
EELNMDLFRSTMKPVQKVL (BiP 328-346 Hcit)

(SEQ ID NO: 46)
RNELESYAYSLKNQIGDK (BiP 562-579 Hcit)

(SEQ ID NO: 48)
PLRPQNYLFGCELKADK (NPM 11-27 Hcit)

(SEQ ID NO: 52)
GGSLPKVEAKFINYVKNCFR (NPM 258-277 Hcit)

(SEQ ID NO: 53)
AKFINYVKNCFRMTDQEAIQDL (NPM 266-287 Hcit)

(SEQ ID NO: 57)
GSHAGNKLAMQEFMILPVGAA (Alpha enolase 156-176 Hcit)

(SEQ ID NO: 60)
DVAASEFFRSGKYDLDFKSP (Alpha enolase 245-264 Hcit)

(SEQ ID NO: 64)
RSERLAKYNQLLRIEEELGS (Alpha enolase 400-419 Hcit)
``` or ii) one or more of the amino acid sequences of i), with the exception of 1, 2 or 3 amino acid substitutions, and/or 1, 2 or 3 amino acid insertions, and/or 1, 2 or 3 amino acid deletions in a non-lysine position. The epitope may have a total of 1, 2, 3, 4 or 5 amino acid modifications selected from substitutions, insertions and substitutions in a non-lysine position.

The T cell epitope of the present invention may comprise, consist essentially of, or consist of i) one or more of the following amino acid sequences:

```
                                        (SEQ ID NO: 3)
NYID-Hcit-VRFLEQQN-Hcit-ILLAEL (Vimentin 116-135 Hcit)

(SEQ ID NO: 4)
LARLDLER-Hcit-VESLQEEIAFL-Hcit (Vimentin 215-235 Hcit)

(SEQ ID NO: 5)
QIDVDVS-Hcit-PDLTAALRDVRQQ (Vimentin 255-275 Hcit)

(SEQ ID NO: 6)
EAEEWY-Hcit-S-Hcit-FADLSEAAN (Vimentin 286-303 Hcit)

(SEQ ID NO: 7)
LPLVDTHS-Hcit-RTLL-Hcit-TVETRDGQV (Vimentin 431-454 Hcit)

(SEQ ID NO: 8)
F-Hcit-NTRTN E-Hcit-VELQELNDRFA (Vimentin 96-115 Hcit)

(SEQ ID NO: 9)
TNE-Hcit-VELQELNDRFANYID-Hcit-VR (Vimentin 101-122 Hcit)
```

-continued

```
                                                       (SEQ ID NO: 10)
KVRFLEQQN-Hcit-LLAE (Vimentin 120-134 Hcit)

(SEQ ID NO: 11)
DVRQQYESVAA-Hcit-NLQEAE (Vimentin 271-288 Hcit)

(SEQ ID NO: 12)
EAEEWY-Hcit-S-Hcit-FADLSEAANRN (Vimentin 286-305 Hcit)

(SEQ ID NO: 13)
FSLADAINTEF-Hcit-NTRTNE-Hcit-VELQ (Vimentin 86-108 Hcit)

(SEQ ID NO: 14)
Hcit-MALD IE IATYR-Hcit-LLEGEE (Vimentin 390-408 Hcit)

(SEQ ID NO: 15)
IGGVILFHETLYQ-Hcit-ADDGRP (Aldolase 74-93 Hcit)

(SEQ ID NO: 16)
Hcit-DGADFA-Hcit-WRCVL-Hcit-IGEH (Aldolase 140-157 Hcit)

(SEQ ID NO: 17)
LSDHH IYLEGTLL-Hcit-PNMVT (Aldolase 217-235 Hcit)

(SEQ ID NO: 18)
HACTQ-Hcit-FSHEEIAMATVTA (Aldolase 238-256 Hcit)

(SEQ ID NO: 19)
Hcit-CPLL-Hcit-PWALTFSYGRALQ (Aldolase 289-307 Hcit)

(SEQ ID NO: 20)
DL-Hcit-RCQYVTE-Hcit-VLAAVY-Hcit-A (Aldolase 198-216 Hcit)

(SEQ ID NO: 21)
AAQEEYV-Hcit-RALANSLACQG-Hcit (Aldolase 323-342 Hcit)

(SEQ ID NO: 22)
Hcit-VLAAVY-Hcit-ALSDHHIYLEG (Aldolase 208-226 Hcit)

(SEQ ID NO: 23)
YVTE-Hcit-VLAAVY-Hcit-ALSD (Aldolase 204-219 Hcit)

(SEQ ID NO: 24)
VLAAVY-Hcit-AL (Aldolase 209-217)

(SEQ ID NO: 25)
KFASFID-Hcit-VRFLEQQN-Hcit-MLE (Cytakeratin 8 101-120 Hcit)

(SEQ ID NO: 26)
LEQQN-Hcit-MLET-Hcit-WSLLQQQ-Hcit-T (Cytokeratin 8 112-131 Hcit)

(SEQ ID NO: 27)
Hcit-MLET-Hcit-WSL (Cytokeratin 8 117-125)

(SEQ ID NO: 28)
EN-Hcit-RTEMENEFVLI-Hcit-Htt-DVDE (Cytokeratin 8 182-202 Hcit)

(SEQ ID NO: 29)
LREYOELMNV-Hcit-LALDIEI (Cytokeratin 8 371-388 Hcit)

(SEQ ID NO: 30)
Hcit-LALDIEIATYR-Hcit-LLEGEE (Cytokeratin 8 381-399 Hcit)

(SEQ ID NO: 31)
ET-Hcit-VVSLLQQQ-Hcit-TARSNMONIVIF (Cytokeratin 8 120-140 Hcit)

(SEQ ID NO: 32)
EQI-Hcit-SINN-Hcit-FASFID-HCit-VRFL (CytokerAn 8 93-112 Hcit)

(SEQ ID NO: 33)
ENEFVU-Hcit-Hcit-DVDEAYMN-Hcit-V (Cytokeratin 8 190-208 Hcit)

(SEQ ID NO: 34)
G-Hcit-HGDDLRRT-Hcit-TBSEM (Cytokeratin 8 294-310 Hcit)

(SEQ ID NO: 35)
ROLREYGELMNV-Hcit-LALEI (Cytokeratin 8 369-388 Hcit)

(SEQ ID NO: 36)
EIEGL-Hcit-GQRASLEAAIADA (Cytokeratin 8 320-338 Hcit)
```

-continued

```
                                                     (SEQ ID NO: 37)
EQRGELAI-Hcit-DANA-Hcit-LSELEA (Cytokeratin 8 339-358 Hcit)

(SEQ ID NO: 38)
NDPSVQQDI-Hcit-FLPF-Hcit-VVE-Hcit-Hcit-T (BiP 104-124 Hcit)

(SEQ ID NO: 39)
EISAMVLT-Hcit-M-Hcit-ETAEA (BiP 144-159 Hcit)

(SEQ ID NO: 40)
GEDFDQRVMEHFI-Hcit-LY-Hcit-Hcit-Hcit-TG (BiP 255-275 Hcit)

(SEQ ID NO: 41)
OKIRREVEKAKRALSSOHQAR (BP 286-306 Hcit)

(SEQ ID NO: 42)
EDFSETLTRA-Hcit-FEELNMDLFR (BiP 316-336 Hcit)

(SEQ ID NO: 43)
EELNMDLFRSTM-Hcit-PVQ-Hcit-VL (BiP 328-346 Hcit)

(SEQ ID NO: 44)
RIP-Hcit-IQQLV-Hcit-EFFNG-Hcit-EPSRG (BiP 367-387 Hcit)

(SEQ ID NO: 45)
TVTI-Hcit-VYEGERPLT-Hcit-DNHLLG (BiP 460-480 Hcit)

(SEQ ID NO: 46)
RNELESYAYSL-Hcit-NQIGD-Hcit- (BiP 562-579 Hcit)

(SEQ ID NO: 47)
Hcit-Hcit-ELEENOPIS-Hcit-LYGSAG (BiP 620-639 Hcit)

(SEQ ID NO: 48)
PLRPQNYLFGCEL-Hcit-AD-Hcit- (NPM 11-27 Hcit)

(SEQ ID NO: 49)
EGSPIKVTLATLKMSVQPTVSL (NPM 68-89 Hcit)

(SEQ ID NO: 50)
EEEDV-Hcit-LLSISG-Hcit-RSAPGGGS (NPM 129-149 Hcit)

(SEQ ID NO: 51)
S-Hcit-GQESF-Hcit-Hcit-QE-Hcit-TP-Hcit-TP-Hcit-G (NPM 222-240 Hcit)

(SEQ ID NO: 52)
GGSLP-Hcit-VEA-Hcit-FINYV-Hcit-NCFR (NPM 258-277 Hcit)

(SEQ ID NO: 53)
A-Hcit-FINYV-Hcit-NCFRMTDQEAIQDL (NPM 266-287 Hcit)

(SEQ ID NO: 54)
MSIL-Hcit-IHAREIFDSRG (Alpha enolase 1-16 Hcit)

(SEQ ID NO: 55)
ND-Hcit-TRYMG-Hcit-GVS-Hcit-AVEHI (Alpha enolase 52-69 Hcit)

(SEQ ID NO: 56)
TEN-Hcit-S-Hcit-FGANAILGVSLAVC-Hcit-A (Alpha enolase 100-121 Hcit)

(SEQ ID NO: 57)
GSHAGN-Hcit-LAMQEFMILPVGAA (Alpha enolase 156-176 Hcit)

(SEQ ID NO: 58)
REAMRIGAEVYHNL-Hcit-NVI-Hcit- (Alpha enolase 179-197 Hcit)

(SEQ ID NO: 59)
NVI-Hcit-E-Hcit-YG-Hcit-DAINVGDEGG (Alpha enolase 194-212 Hcit)

(SEQ ID NO: 60)
DVAASEFFRSG-Hcit-YDLDF-Hcit-SP (Alpha enolase 245-264 Hcit)

(SEQ ID NO: 61)
PDQLADLY-Hcit-SFI-Hcit-DYPVVS (Alpha enolase 273-291 Ha)

(SEQ ID NO: 62)
WGAWQ-Hcit-FTASAGIQVVG (Alpha enolase 301-317 Hcit)

(SEQ ID NO: 63)
N-Hcit-SCNCLLL-Hcit-VNQIGSVIE (Alpha enolase 333-352 Hcit)
```

-continued

```
                                                    (SEQ ID NO: 64)
RSERLA-Hcit-YNQLLRIEEELGS (Alpha enolase 400-419 Hcit)

(SEQ ID NO: 65)
GS-Hcit-A-Hcit-FAGRNFRN PLA-Hcit- (Alpha enolase 418-434 Hcit)

(SEQ ID NO: 66)
EPSOML-Hcit-HAVVNLINYQD (Beta-Catenin 127-144 Hcit)

(SEQ ID NO: 67)
E-Hcit-LLWIT SRVL-Hcit-VLSVCSSN-Hcit (Beta-Catenin 334-354 Hcit)

(SEQ ID NO: 68)
TLHNLLLHQEGA-Hcit-MAVRL (Beta-Catenin 258-275 Hcit)

(SEQ ID NO: 69)
A-Hcit-MAVRLAGGLQ-Hcit-MVALLN-Hcit (Beta-Caten1n 269-288 Hcit)

(SEQ ID NO: 70)
-Hcit-INV-Hcit-FLAITTDCLQILAYG (Beta-Catenin 288-307 Hcit)

(SEQ ID NO: 71)
TYE-Hcit-LLVVTTSRVL-Hcit-VLSV (Beta-Caten in 332-349 Hcit)

(SEQ ID NO: 72)
TSRVL-Hcit-VLSVCSSN-Hcit-PAIV (Beta-Catenin 340-358 Hcit)

(SEQ ID NO: 73)
YGLPVVV-Hcit-LLHPFSHVVPL (Beta-Catenin 489-506 Hcit)

(SEQ ID NO: 74)
HVVPLI-Hcit-ATVGLIRNLALCPA (Beta-Catenin 503-522 Hcit)

(SEQ ID NO: 75)
IENIQRVAAGVLCELAQD-Hcit- (Beta-Catenin 607-625 Hcit)

(SEQ ID NO: 76)
GVATYAAAVLFRMSED-Hcit-P (Beta-Catenin 650-667 Hcit)

(SEQ ID NO: 77)
IDLKDKYKNIGAKLVQDVAN (HSP60 84-103 Hcit)

(SEQ ID NO: 78)
TVLARSIA-Hcit-EGFE-Hcit-IS-Hcit-GAN (HSP60 117-136 Hcit)

(SEQ ID NO: 79)
GEALSTLVLNRL-Hcit-VGLQVVA (HSP60 280-299 Hcit)

(SEQ ID NO: 80)
TTSEYE-Hcit-E-Hcit-LNERLA-Hcit-LS (HSP60 381-398 Hcit)

(SEQ ID NO: 81)
GIIDPTV-Hcit-VRTALLDAAGVA (HSP60 517-536 Hcit)
``` wherein "cit" represents homocitrulline, or ii) one or more of the amino acid sequences of), with the exception of 1, 2 or 3 amino acid substitutions, and/or 1, 2 or 3 amino acid insertions, and/or 1, 2 or 3 amino acid deletions in a non-homocitrulline position. The epitope peptide may have at total of 1, 2, 3, 4 or 5 amino acid modifications selected from substitutions, insertions and substitutions in a non-homocitrulline position.

The inventors have unexpectedly found that homocitrullinated peptides derived from vimentin and ALDOA can be used to raise an immune response against tumours including, but not restricted to, pancreatic, renal, melanoma, head and neck, breast and lung tumours. The inventors have shown that the following eleven peptides:

```
                                                    (SEQ ID NO: 3)
NYID-Hcit-VRFLEQQN-Hcit-ILLAEL (Vimentin 116-135 Hcit)*

(SEQ ID NO: 11)
DVRQQYESVAA-Hcit-NLQEAE (Vimentin 271-288 Hcit)

(SEQ ID NO: 12)
EAEEWY-Hcit-S-Hcit-FADLSEAANRN (Vimentin 286-305 Hcit)

(SEQ ID NO: 15)
IGGVILFHETLYQ-Hcit-ADDGRP (ALDOA 74-93 Hcit)*
```

```
                                                        (SEQ ID NO: 16)
Hcit-DGADFA-Hcit-WRCVL-Hcit-IGEH (ALDOA 140-157 Hcit)*

(SEQ ID NO: 18)
HACTQ-Hcit-FSHEEIAMATVTA (ALDOA 238-256 Hcit)

(SEQ ID NO: 25)
KFASFID-Hcit-VRFLEQQN-Hcit-MLE (Cytokeratin 8 101-120 Hcit)

(SEQ ID NO: 26)
LEQQN-Hcit-MLET-Hcit-WSLLQQQ-Hcit-T (Cytokeratin 8 112-131 Hcit)*

(SEQ ID NO: 28)
EN-HcAt-RTEMENEFVLI-Hcit-HcAt-DVDE (Cytokeratin 8 182-202 Hcit)

(SEQ ID NO: 29)
LREYOELMNV-Hcit-LALDIEI (Cytokeratin 8 371-388 Hcit)*

(SEQ ID NO: 30)
Hcit-LALDIEIATYR-Hcit-LLEGEE (Cytokeratin 8 381-399 Hcit)
``` generated a T cell response, and 5/5* of these peptides tested (*) an anti-tumour response in vivo to a homocitrullinated vimentin, ALDOA or cytokeratin 8 epitope.

The inventors have unexpectedly found that further homocitrullinated peptides derived from vimentin, ALDOA, enolase, BiP, nucleophosmin, cytokeratin 8 and HSP60 can be used to raise an immune response against tumours including, but not restricted to, pancreatic, renal, melanoma, head and neck, breast and lung tumours. The inventors have shown that the following fourteen peptides:

```
                                                        (SEQ ID NO: 13)
FSLADAINTEF-Hcit-NTRTNE-Hcit-VELQ (Vimentin 86-108 Hcit)*

(SEQ ID NO: 14)
Hcit-MALDIEIATYR-Hcit-LLEGEE (Vimentin 390-408 Hcit)

(SEQ ID NO: 23)
YVTE-Hcit-VLAAVY-Hcit-ALSD (Aldolase 204-219 Hcit)

(SEQ ID NO: 20)
DL-Hcit-RCQYVTE-Hcit-VLAAVY-Hcit-A (Aldolase 198-216 Hcit)

(SEQ ID NO: 42)
EDFSETLTRA-Hcit-FEELNMDLFR (BiP 316-336 Hcit)

(SEQ ID NO: 43)
EELNMDLFRSTM-Hcit-PVQ-Hcit-VL (BiP 328-346 Hcit)

(SEQ ID NO: 46)
RNELESYAYSL-Hcit-NQIGD-Hcit- (BiP 562-579 Hcit)*

(SEQ ID NO: 48)
PLRPQNYLFGCEL-Hcit-AD-Hcit- (NPM 11-27 Hcit)

(SEQ ID NO: 52)
GGSLP-Hcit-VEA-Hcit-FINYV-Hcit-NCFR (NPM 258-277 Hcit)

(SEQ ID NO: 53)
A-Hcit-FINYV-Hcit-NCFRMTDQEAIQDL (NPM 266-287 Hcit)*

(SEQ ID NO: 57)
GSHAGN-Hcit-LAMQEFMILPVGAA (Alpha enolase 156-176 Hcit)*

(SEQ ID NO: 60)
DVAASEFFRSG-Hcit-YDLDF-Hcit-SP (Alpha enolase 245-264 Hcit)

(SEQ ID NO: 64)
RSERLA-Hcit-YNQLLRIEEELGS (Alpha enolase 400-419 Hcit)
``` generated a T cell response, and four of these peptides tested (*) an anti-tumour response in vivo to a homocitrullinated vimentin, BiP, NPM or α-enolase epitope.

Vimentin, ALDOA, cytokeratin 8 BiP, NPM, α-enolase, β-catenin and HSP60 are highly conserved between those species in which the gene has been cloned (mouse, rat, sheep, cow, horse rabbit, pig, chicken and human). Accordingly, an epitope of the invention, optionally in combination with a nucleic acid comprising a sequence that encodes such a peptide, can be used for treating cancer in humans and in non-human mammals. The cancer may be pancreatic, renal, melanoma, head and neck, breast or lung cancer, Burkitt's lymphoma, chronic lymphocytic leukaemia, melanoma, pancreatic adenocarcinoma, breast cancer, colon cancer, acute lymphoblastic leukaemia or acute myeloid leukaemia.

The invention also includes within its scope epitopes having the amino acid sequence as set out above and sequences having substantial identity thereto, for example, 70%, 80%, 85%, 90%, 95% or 99% identity thereto, as well as their use in medicine and in particular in a method for treating cancer. The percent identity of two amino acid sequences or of two nucleic acid sequences is generally determined by aligning the sequences for optimal comparison purposes (e.g., gaps can be introduced in the first sequence for best alignment with the second sequence) and comparing the amino acid residues or nucleotides at corresponding positions. The "best alignment" is an alignment of two sequences that results in the highest percent identity. The percent identity is determined by comparing the number of identical amino acid residues or nucleotides within the sequences (i.e., % identity=number of identical positions/total number of positions×100).

The determination of percent identity between two sequences can be accomplished using a mathematical algorithm known to those of skill in the art. An example of a mathematical algorithm for comparing two sequences is the algorithm of Karlin and Altschul modified as in (Karlin and Altschul 1993). The NBLAST and XBLAST programs of Altschul, et al. have incorporated such an algorithm (Altschul et al. 1990). BLAST nucleotide searches can be performed with the NBLAST program, score =100, wordlength=12 to obtain nucleotide sequences homologous to a nucleic acid molecule of the invention. BLAST protein searches can be performed with the XBLAST program, score=50, wordlength=3 to obtain amino acid sequences homologous to a protein molecule of the invention. To obtain gapped alignments for comparison purposes, Gapped BLAST can be utilised as described in (Altschul et al. 1997). Alternatively, PSI-Blast can be used to perform an iterated search that detects distant relationships between molecules. When utilising BLAST, Gapped BLAST, and PSI-Blast programs, the default parameters of the respective programs (e.g., XBLAST and NBLAST) can be used. See ncbi.nlm.nih.gov. Another example of a mathematical algorithm utilised for the comparison of sequences is the algorithm of Myers and Miller (Myers and Miller 1989). The ALIGN program (version 2.0) which is part of the GCG sequence alignment software package has incorporated such an algorithm. Other algorithms for sequence analysis known in the art include ADVANCE and ADAM as described in (Torelli and Robotti 1994) and FASTA described in (Pearson and Lipman 1988). Within FASTA, ktup is a control option that sets the sensitivity and speed of the search.

Amino acid substitution means that an amino acid residue is substituted for a replacement amino acid residue at the same position. Inserted amino acid residues may be inserted at any position and may be inserted such that some or all of the inserted amino acid residues are immediately adjacent one another or may be inserted such that none of the inserted amino acid residues is immediately adjacent another inserted amino acid residue.

The antigen of the invention may comprise one, two or three additional amino acids at the C-terminal end and/or at the N-terminal end thereof. An antigen of the invention may comprise the amino acid sequence set out above with the exception of one amino acid substitution and one amino acid insertion, one amino acid substitution and one amino acid deletion, or one amino acid insertion and one amino acid deletion. An antigen of the invention may comprise the amino acid sequence set out above, with the exception of one amino acid substitution, one amino acid insertion and one amino acid deletion.

Inserted amino acids and replacement amino acids may be naturally occurring amino acids or may be non-naturally occurring amino acids and, for example, may contain a non-natural side chain. Such altered peptide ligands are discussed further in Douat-Casassus et al., J. Med. Chem, 2007 Apr. 5;50 (7): 1598-609 and Hoppes et al., J. Immunol 2014 Nov. 15;193 (10): 4803-13 and references therein). If more than one amino acid residue is substituted and/or inserted, the replacement/inserted amino acid residues may be the same as each other or different from one another. Each replacement amino acid may have a different side chain to the amino acid being replaced.

Preferably, antigens of the invention bind to MHC in the peptide binding groove of the MHC molecule. Generally, the amino acid modifications described above will not impair the ability of the peptide to bind MHC. In a preferred embodiment, the amino acid modifications improve the ability of the peptide to bind MHC. For example, mutations may be made at positions which anchor the peptide to MHC. Such anchor positions and the preferred residues at these locations are known in the art.

An antigen of the invention may be used to elicit an immune response. If this is the case, it is important that the immune response is specific to the intended target in order to avoid the risk of unwanted side effects that may be associated with an "off target" immune response. Therefore, it is preferred that the amino acid sequence of a polypeptide of the invention does not match the amino acid sequence of a peptide from any other protein(s), in particular, that of another human protein. A person of skill in the art would understand how to search a database of known protein sequences to ascertain whether an epitope according to the invention is present in another protein.

Epitopes of the invention can be synthesised easily by Merrifield synthesis, also known as solid phase synthesis, or any other peptide synthesis methodology. GMP grade polypeptide is produced by solid-phase synthesis techniques by Multiple Peptide Systems, San Diego, CA. Alternatively, the peptide may be recombinantly produced, if so desired, in accordance with methods known in the art. Such methods typically involve the use of a vector comprising a nucleic acid sequence encoding the polypeptide to be expressed, to express the polypeptide in vivo; for example, in bacteria, yeast, insect or mammalian cells. Alternatively, in vitro cell-free systems may be used. Such systems are known in the art and are commercially available for example from Life Technologies, Paisley, UK. The antigens may be isolated and/or may be provided in substantially pure form. For example, they may be provided in a form which is substantially free of other polypeptides or proteins. Peptides of the invention may be synthesised using Fmoc chemistry or other standard techniques known to those skilled in the art.

In a second aspect, the invention provides a complex of the antigen of the first aspect and an MHC molecule. Preferably, the antigen is bound to the peptide binding groove of the MHC molecule. The MHC molecule may be MHC class II. The MHC class II molecule may be a DP or DQ allele, such as HLA-DR4, DR1, DP4, DP2, DP5, DQ2, DQ3, DQ5 and DQ6. HLA-DR4, DR1 and DP4 are preferred. The MHC molecule may be MHC class I. The MHC class I molecule may be a A, B or C allele, such as HLA-A2, A1, A3, A24, A32, B7, B8, B15, B35, B44, C3, C7, C6, C5. HLA-A2 is preferred. The complex of the invention may be isolated and/or in a substantially pure form. For example, the complex may be provided in a form which is substantially free of other polypeptides or proteins. It should be noted that in the context of the present invention, the term "MHC molecule" includes recombinant MHC molecules, non-naturally occurring MHC molecules and functionally equivalent fragments of MHC, including derivatives or variants thereof, provided that peptide binding is retained. For example, MHC molecules may be fused to a therapeutic moiety, attached to a solid support, in soluble form, and/or in multimeric form.

Methods to produce soluble recombinant MHC molecules with which antigens of the invention can form a complex are known in the art. Suitable methods include, but are not limited to, expression and purification from *E. coli* cells or insect cells. Alternatively, MHC molecules may be produced synthetically, or using cell free systems.

Epitopes and/or epitope-MHC complexes of the invention may be associated with a moiety capable of eliciting a therapeutic effect. Such a moiety may be a carrier protein which is known to be immunogenic. KLH (keyhole limpet hemocyanin) is an example of a suitable carrier protein used in vaccine compositions. Alternatively, the epitopes and/or epitope-MHC complexes of the invention may be associated with a fusion partner. Fusion partners may be used for detection purposes, or for attaching said epitope or MHC to a solid support, or for MHC oligomerisation. The MHC complexes may incorporate a biotinylation site to which biotin can be added, for example, using the BirA enzyme (O'Callaghan et al., 1999 Jan. 1;266 (1): 9-15). Other suitable fusion partners include, but are not limited to, fluorescent, or luminescent labels, radiolabels, nucleic acid probes and contrast reagents, antibodies, or enzymes that produce a detectable product. Detection methods may include flow cytometry, microscopy, electrophoresis or scintillation counting.

Epitope-MHC complexes of the invention may be provided in soluble form or may be immobilised by attachment to a suitable solid support. Examples of solid supports include, but are not limited to, a bead, a membrane, sepharose, a magnetic bead, a plate, a tube, a column. Epitope-MHC complexes may be attached to an ELISA plate, a magnetic bead, or a surface plasmon reasonance biosensor chip. Methods of attaching epitope-MHC complexes to a solid support are known to the skilled person, and include, for example, using an affinity binding pair, e.g. biotin and streptavidin, or antibodies and antigens. In a preferred embodiment epitope-MHC complexes are labelled with biotin and attached to streptavidin-coated surfaces.

Epitope-MHC complexes of the invention may be in multimeric form, for example, dimeric, or tetrameric, or pentameric, or octomeric, or greater. Examples of suitable methods for the production of multimeric peptide MHC complexes are described in Greten et al., Clin. Diagn. Lab. Immunol. 2002 March;9 (2): 216-20 and references therein. In general, epitope-MHC multimers may be produced using epitope-MHC tagged with a biotin residue and complexed through fluorescent labelled streptavidin. Alternatively, multimeric epitope-MHC complexes may be formed by using immunoglobulin as a molecular scaffold. In this system, the extracellular domains of MHC molecules are fused with the constant region of an immunoglobulin heavy chain separated by a short amino acid linker. Epitope-MHC multimers have also been produced using carrier molecules such as dextran (WO02072631). Multimeric epitope-MHC complexes can be useful for improving the detection of binding moieties, such as T cell receptors, which bind said complex, because of avidity effects.

The epitopes of the invention may be presented on the surface of a cell in complex with MHC. Thus, the invention also provides a cell presenting on its surface a complex of the invention. Such a cell may be a mammalian cell, preferably a cell of the immune system, and in particular a specialised antigen presenting cell such as a dendritic cell or a B cell. Other preferred cells include T2 cells (Hosken, et al., Science. 1990 Apr. 20;248 (4953): 367-70). Cells presenting the epitope or complex of the invention may be isolated, preferably in the form of a population, or provided in a substantially pure form. Said cells may not naturally present the complex of the invention, or alternatively said cells may present the complex at a level higher than they would in nature. Such cells may be obtained by pulsing said cells with the epitope of the invention. Pulsing involves incubating the cells with the epitope for several hours using polypeptide concentrations typically ranging from 10-5 to 10-12 M. Cells may be produced recombinantly. Cells presenting epitope of the invention may be used to isolate T cells and T cell receptors (TCRs) which are activated by, or bind to, said cells, as described in more detail below.

Epitopes and complexes of the invention can be used to identify and/or isolate binding moieties that bind specifically to the epitope and/or the complex of the invention. Such binding moieties may be used as immunotherapeutic reagents and may include antibodies and TCRs.

In a third aspect, the invention provides a binding moiety that binds the epitope of the invention. Preferably the binding moiety binds the antigen when said polypeptide is in complex with MHC. In the latter instance, the binding moiety may bind partially to the MHC, provided that it also binds to the antigen. The binding moiety may bind only the epitope, and that binding may be specific. The binding moiety may bind only the epitope-MHC complex and that binding may be specific.

When used with reference to binding moieties that bind the complex of the invention, "specific" is generally used herein to refer to the situation in which the binding moiety does not show any significant binding to one or more alternative epitope-MHC complexes other than the epitope-MHC complex of the invention.

The binding moiety may be a T cell receptor (TCR). TCRs are described using the International Immunogenetics (IMGT) TCR nomenclature, and links to the IMGT public database of TCR sequences. The unique sequences defined by the IMGT nomenclature are widely known and accessible to those working in the TCR field. For example, they can be found in the "T cell Receptor Factsbook", (2001) LeFranc and LeFranc, Academic Press, ISBN 0-12-441352-8; Lefranc, (2011), Cold Spring Harb Protoc 2011 (6): 595-603; Lefranc, (2001), Curr Protoc Immunol Appendix 1: Appendix 10; Lefranc, (2003), Leukemia 17 (1): 260-266, and on the IMGT website (IMGT.org)

The TCRs of the invention may be in any format known to those in the art. For example, the TCRs may be αβ heterodimers, or they may be in single chain format (such as those described in WO9918129). Single chain TCRs include αβ TCR polypeptides of the type: Vα-L-Vβ, Vβ-L-Vα, Vα-Cα-L-Vβ, Vα-L-Vβ-Cβ or Vα-Cα-L-Vβ-Cβ, optionally in the reverse orientation, wherein Vα and Vβ are TCR α and β variable regions respectively, Cα and Cβ are TCR α and β constant regions respectively, and L is a linker sequence. The TCR may be in a soluble form (i.e. having no transmembrane or cytoplasmic domains), or may contain full length alpha and beta chains. The TCR may be provided on the surface of a cell, such as a T cell. The cell may be a mammalian cell, such as a human cell.

The cell may be used in medicine, in particular for treating cancer. The cancer may be a solid tumour or a haematological neoplasia. The cancer may be pancreatic, renal, melanoma, head and neck, breast, lung cancer, Burkitt's lymphoma, chronic lymphocytic leukaemia, melanoma, pancreatic adenocarcinoma, breast cancer, colon cancer, acute lymphoblastic leukaemia or acute myeloid leukaemia. The cells may be autologous to the subject to be treated or not autologous to the subject to be treated.

The alpha and/or beta chain constant domain of the TCR of the invention may be truncated relative to the native/naturally occurring TRAC/TRBC sequences. In addition, the TRAC/TRBC may contain modifications. For example, the alpha chain extracellular sequence may include a modification relative to the native/naturally occurring TRAC whereby amino acid T48 of TRAC, with reference to IMGT numbering, is replaced with C48. Likewise, the beta chain extracellular sequence may include a modification relative to the native/naturally occurring TRBC1 or TRBC2 whereby S57 of TRBC1 or TRBC2, with reference to IMGT numbering, is replaced with C57. These cysteine substitutions relative to the native alpha and beta chain extracellular sequences enable the formation of a non-native interchain disulphide bond which stabilises the refolded soluble TCR, i.e. the TCR formed by refolding extracellular alpha and beta chains (WO 03/020763). This non-native disulphide bond facilitates the display of correctly folded TCRs on phage. (Li et al., Nat Biotechnol 2005 March;23 (3): 349-54). In addition, the use of the stable disulphide linked soluble TCR enables more convenient assessment of binding affinity and binding half-life. Alternative positions for the formation of a non-native disulphide bond are described in WO 03/020763.

Particular TCRs of the invention include those comprising the pairs of alpha and beta chain chain variable regions set out in FIGS. 28-35, 37-45, and 47-52 herein. A person skilled in the art will appreciate that approximately 10-20 amino acids at the C terminus of these amino acid sequences can be excluded as these form part of the constant domain. TCRs of the invention may comprise an alpha chain variable domain and a beta chain variable domain with the CDRs of the pairs of alpha and beta chain variable regions set out in these FIGS. 28-35, 37-45, and 47-52 herein. Thus, TCRs of the present invention may comprise the following CDRs:

| TCRBeta chain | Alpha chain |
|---|---|
| 9 CDR1: ENHRY (SEQ ID NO: 85)<br>CDR2: SYGVKD (SEQ ID NO: 86)<br>CDR3: AISERRDQETQY (SEQ ID NO: 87) | CDR1: TISGTDY (SEQ ID NO: 88)<br>CDR2: GLTSN (SEQ ID NO: 89)<br>CDR3: ILRDVYDYKLS (SEQ ID NO: 90) |
| 10 CDR1: DFQATT (SEQ ID NO: 91)<br>CDR2: SNEGSKA (SEQ ID NO: 92)<br>CDR3: SAPIHTDTQY (SEQ ID NO: 93) | CDR1: VTNFRS (SEQ ID NO: 94)<br>CDR2: LTSSGIE (SEQ ID NO: 95)<br>CDR3: AVHDAGNMLT (SEQ ID NO: 96) |
| 11 CDR1: SGHDY (SEQ ID NO: 97)<br>CDR2: FNNNVP (SEQ ID NO: 98)<br>CDR3: ASRGGLASNEQF (SEQ ID NO: 99) | CDR1: SSVSVY (SEQ ID NO: 100)<br>CDR2: YLSGSTLV (SEQ ID NO: 101)<br>CDR3: AVSEGGGSYIPT (SEQ ID NO: 102) |
| 12 CDR1: LNHDA (SEQ ID NO: 103)<br>CDR2: SQIVND (SEQ ID NO: 104)<br>CDR3: ASSLGTFYEQY (SEQ ID NO: 105) | CDR1: DSASNY (SEQ ID NO: 106)<br>CDR2: IRSNVGE (SEQ ID NO: 107)<br>CDR3: AASGNTNAGKST (SEQ ID NO: 108) |
| 13 CDR1: YFSETQ (SEQ ID NO: 109)<br>CDR2: SGHRS (SEQ ID NO: 110)<br>CDR3: ASSLGVMVVSTDTQY (SEQ ID NO: 111) | CDR1: TISGTDY (SEQ ID NO: 88)<br>CDR2: GLTSN (SEQ ID NO: 89)<br>CDR3: ILRDRVSNFGNEKLT (SEQ ID NO: 112) |
| 14 CDR1: SGHAT (SEQ ID NO: 113)<br>CDR2: FQNNGV (SEQ ID NO: 114)<br>CDR3: ASSPTQGASYEQY (SEQ ID NO: 115) | CDR1: VSGNPY (SEQ ID NO: 116)<br>CDR2: YITGDNLV (SEQ ID NO: 117)<br>CDR3: AVRDAGYSTLT (SEQ ID NO: 118) |
| 16 CDR1: ENHRY (SEQ ID NO: 85)<br>CDR2: SYGVKD (SEQ ID NO: 86)<br>CDR3: AISERRDQETQY (SEQ ID NO: 87) | CDR1: DSASNY (SEQ ID NO: 106)<br>CDR2: IRSNVGE (SEQ ID NO: 107)<br>CDR3: AASIDRDDKII (SEQ ID NO: 119) |
| 17 CDR1: MDHEN (SEQ ID NO: 120)<br>CDR2: SYDVKM (SEQ ID NO: 121)<br>CDR3: ATTQGSYNEQF (SEQ ID NO: 122) | CDR1: VSGLRG (SEQ ID NO: 123)<br>CDR2: LYSAGEE (SEQ ID NO: 124)<br>CDR3: AVQAGSYIPT (SEQ ID NO: 125) |
| 19 CDR1: DFQATT (SEQ ID NO: 91)<br>CDR2: SNEGSKA (SEQ ID NO: 92)<br>CDR3: SARTSGTNTQY (SEQ ID NO: 126) | CDR1: SSVPPY (SEQ ID NO: 127)<br>CDR2: YTSAATLV (SEQ ID NO: 128)<br>CDR3: AVSGRNDYKLS (SEQ ID NO: 129) |
| 20 CDR1: MNHEY (SEQ ID NO: 130)<br>CDR2: SVGEGT (SEQ ID NO: 131)<br>CDR3: ASSRSVVTASGYT (SEQ ID NO: 132) | CDR1: TISGTDY (SEQ ID NO: 88)<br>CDR2: GLTSN (SEQ ID NO: 89)<br>CDR3: ILRDGSGNEKLT (SEQ ID NO: 133) |
| 21 CDR1: SGHNS (SEQ ID NO: 134)<br>CDR2: FNNNVP (SEQ ID NO: 198)<br>CDR3: ASSVAQLAGKGEQF (SEQ ID NO: 135) | CDR1: DSASNY (SEQ ID NO: 106)<br>CDR2: IRSNVGE (SEQ ID NO: 107)<br>CDR3: AASIDRDDKII (SEQ ID NO: 119) |
| 22 CDR1: SNHLY (SEQ ID NO: 136)<br>CDR2: FYNNEI (SEQ ID NO: 137)<br>CDR3: ASRRVMGYGYT (SEQ ID NO: 138) | CDR1: DSAIYN (SEQ ID NO: 139)<br>CDR2: IQSSQRE (SEQ ID NO: 140)<br>CDR3: ALNSGGSNYKLT (SEQ ID NO: 141) |
| 23 CDR1: DFQATT (SEQ ID NO: 91)<br>CDR2: SNEGSKA (SEQ ID NO: 92)<br>CDR3: SAGRAGTSGTYEQY (SEQ ID NO: 142) | CDR1: TISGTDY (SEQ ID NO: 88)<br>CDR2: GLTSN (SEQ ID NO: 89)<br>CDR3: ILRSNFGNEKLT (SEQ ID NO: 143) |
| 24 CDR1: LNHDA (SEQ ID NO: 103)<br>CDR2: SQIVND (SEQ ID NO: 104)<br>CDR3: ASSGGQFNQPQH (SEQ ID NO: 144) | CDR1: NYSPAY (SEQ ID NO: 145)<br>CDR2: IRENEKE (SEQ ID NO: 146)<br>CDR3: ALGQTGANNLF (SEQ ID NO: 147) |

| TCRBeta chain | Alpha chain |
|---|---|
| 25 CDR1: KGHSH (SEQ ID NO: 148)<br>CDR2: LQKENI (SEQ ID NO: 149)<br>CDR3: ASSPEALANTGELF (SEQ ID NO: 150) | CDR1: TISGNEY (SEQ ID NO: 151)<br>CDR2: GLKNN (SEQ ID NO: 152)<br>CDR3: IVRVGYNNNDMR (SEQ ID NO: 153) |
| 26 CDR1: KGHDR (SEQ ID NO: 154)<br>CDR2: SFDVKD (SEQ ID NO: 155)<br>CDR3: ATSDPSGPPYEQY (SEQ ID NO: 156) | CDR1: TISGTDY (SEQ ID NO: 88)<br>CDR2: GLTSN (SEQ ID NO: 89)<br>CDR3: ILRAQGGSEKLV (SEQ ID NO: 157) |
| 27 CDR1: SNHLY (SEQ ID NO: 136)<br>CDR2: FYNNEI (SEQ ID NO: 137)<br>CDR3: ASRAGTGIGGYT (SEQ ID NO: 158) | CDR1: IQSSQRE (SEQ ID NO: 140)<br>CDR2: DSAIYN (SEQ ID NO: 139)<br>CDR3: AVYSGGSNYKLT (SEQ ID NO: 159) |
| 1 CDR1: MDHEN (SEQ ID NO: 120)<br>CDR2: SYDVKM (SEQ ID NO: 121)<br>CDR3: ASSLLGSSPLH (SEQ ID NO: 160) | CDR1: TSESDYY (SEQ ID NO: 161)<br>CDR2: QEAYKQQN (SEQ ID NO: 162)<br>CDR3: AYRSYNQGGKLI (SEQ ID NO: 163) |
| 4 CDR1: LGHDT (SEQ ID NO: 164)<br>CDR2: YNNKEL (SEQ ID NO: 165)<br>CDR3: ASSQEPSTHNEQF (SEQ ID NO: 166) | CDR1: TISGTDY (SEQ ID NO: 88)<br>CDR2: GLTSN (SEQ ID NO: 89)<br>CDR3: ILKNYGGSQGNLI (SEQ ID NO: 167) |
| 5 CDR1: MNHNY (SEQ ID NO: 168)<br>CDR2: SVGAGI (SEQ ID NO: 169)<br>CDR3: ASSPGQPYGYT (SEQ ID NO: 170) | CDR1: YSGSPE (SEQ ID NO: 171)<br>CDR2: HISR (SEQ ID NO: 172)<br>CDR3: ALSGPSYGQNFV (SEQ ID NO: 173) |
| 6 CDR1: MNHNS (SEQ ID NO: 174)<br>CDR2: SASEGT (SEQ ID NO: 175)<br>CDR3: ASEGLASYNEQF (SEQ ID NO: 176) | CDR1: ATGYPS (SEQ ID NO: 177)<br>CDR2: ATKADDK (SEQ ID NO: 178)<br>CDR3: ALTGGGYQKVT (SEQ ID NO: 179) |
| 7 CDR1: MNHEY (SEQ ID NO: 130)<br>CDR2: SMNVEV (SEQ ID NO: 180)<br>CDR3: ASSFREGEKLF (SEQ ID NO: 181) | CDR1: TSINN (SEQ ID NO: 182)<br>CDR2: IRSNERE (SEQ ID NO: 183)<br>CDR3: ATAMNTGFQKLV (SEQ ID NO: 184) |
| 8 CDR1: LGHNA (SEQ ID NO: 185)<br>CDR2: YNFKEQ (SEQ ID NO: 186)<br>CDR3: ASSREGLAGLNEQF (SEQ ID NO: 187) | CDR1: NSMFDY (SEQ ID NO: 188)<br>CDR2: ISISSIKDK (SEQ ID NO: 189)<br>CDR3: AASGWGDGGATNKLI (SEQ ID NO: 190) |

The TCR sequences defined herein are described with reference to IMGT nomenclature which is widely known and accessible to those working in the TCR field. For example, see: LeFranc and LeFranc, (2001). "T cell Receptor Factsbook", Academic Press; Lefranc, (2011), Cold Spring Harb Protoc 2011 (6): 595-603; Lefranc, (2001), Curr Protoc Immunol Appendix 1: Appendix 100; and Lefranc, (2003), Leukemia 17 (1): 260-266. Briefly, alpha beta TCRs consist of two disulphide linked chains. Each chain (alpha and beta) is generally regarded as having two domains, namely a variable and a constant domain. A short joining region connects the variable and constant domains and is typically considered part of the alpha variable region. Additionally, the beta chain usually contains a short diversity region next to the joining region, which is also typically considered part of the beta variable region.

The variable domain of each chain is located N-terminally and comprises three Complementarity Determining Regions (CDRs) embedded in a framework sequence (FR). The CDRs comprise the recognition site for peptide-MHC binding. There are several genes coding for alpha chain variable (Vα) regions and several genes coding for beta chain variable (Vβ) regions, which are distinguished by their framework, CDR1 and CDR2 sequences, and by a partly defined CDR3 sequence. The Vα and Vβ genes are referred to in IMGT nomenclature by the prefix TRAV and TRBV respectively (Folch and Lefranc, (2000), Exp Clin Immunogenet 17 (1): 42-54; Scaviner and Lefranc, (2000), Exp Clin Immunogenet 17 (2): 83-96; LeFranc and LeFranc, (2001), "T cell Receptor Factsbook", Academic Press). Likewise there are several joining or J genes, termed TRAJ or TRBJ, for the alpha and beta chain respectively, and for the beta chain, a diversity or D gene termed TRBD (Folch and Lefranc, (2000), Exp Clin Immunogenet 17 (2): 107-114; Scaviner and Lefranc, (2000), Exp Clin Immunogenet 17 (2): 97-106; LeFranc and LeFranc, (2001), "T cell Receptor Factsbook", Academic Press). The huge diversity of T cell receptor chains results from combinatorial rearrangements between the various V, J and D genes, which include allelic variants, and junctional diversity (Arstila, et al., (1999), Science 286 (5441): 958-961; Robins et al., (2009), Blood 114 (19): 4099-4107.) The constant, or C, regions of TCR alpha and beta chains are referred to as TRAC and TRBC respectively (Lefranc, (2001), Curr Protoc Immunol Appendix 1: Appendix 10). TCRs of the invention may be engineered to include mutations. Methods for producing mutated high affinity TCR variants such as phage display and site directed mutagenesis and are known to those in the art (for example see WO 04/044004 and Li et al., Nat Biotechnol 2005 March;23 (3): 349-54).

TCRs of the invention may also be may be labelled with an imaging compound, for example a label that is suitable for diagnostic purposes. Such labelled high affinity TCRs are useful in a method for detecting a TCR ligand selected from CD1-antigen complexes, bacterial superantigens, and MHC-peptide/superantigen complexes, which method comprises contacting the TCR ligand with a high affinity TCR (or a multimeric high affinity TCR complex) which is specific for the TCR ligand; and detecting binding to the TCR ligand. In multimeric high affinity TCR complexes such as those described in Zhu et al., J. Immunol. 2006 Mar. 1;176 (5): 3223-32, (formed, for example, using biotinylated heterodimers) fluorescent streptavidin (commercially available) can be used to provide a detectable label. A fluorescentlylabelled multimer is suitable for use in FACS analysis, for example to detect antigen presenting cells carrying the peptide for which the high affinity TCR is specific.

According to the invention, peptides containing homocitrulline can be used as targets for cancer immunotherapy via T cell receptors (TCRs). TCRs are designed to recognise short peptide antigens that are displayed on the surface of APCs in complex with MHC molecules (Davis et al. 1998). The identification of particular homocitrulline containing peptides is advantageous for the development of novel immunotherapies. Such therapeutic TCRs may be used, for example, as soluble targeting agents for the purpose of delivering cytotoxic or immune effector agents to the tumour (Boulter et al. 2003; Liddy et al. 2012; Lissin, Hassan, and Jakobsen 2013), or alternatively they may be used to engineer T cells for adoptive therapy (June et al. 2014).

A TCR of the present invention (or multivalent complex thereof) may alternatively or additionally be associated with (e.g. covalently or otherwise linked to) a therapeutic agent which may be, for example, a toxic moiety for use in cell killing, or an immunostimulating agent such as an interleukin or a cytokine. A multivalent high affinity TCR complex of the present invention may have enhanced binding capability for a TCR ligand compared to a non-multimeric wild-type or high affinity T cell receptor heterodimer. Thus, the multivalent high affinity TCR complexes according to the invention are particularly useful for tracking or targeting cells presenting particular antigens in vitro or in vivo, and are also useful as intermediates for the production of further multivalent high affinity TCR complexes having such uses. The high affinity TCR or multivalent high affinity TCR complex may therefore be provided in a pharmaceutically acceptable formulation for use in vivo.

High affinity TCRs of the invention may be used in the production of soluble bi-specific reagents. A preferred embodiment is a reagent which comprises a soluble TCR, fused via a linker to an anti-CD3 specific antibody fragment. Further details including how to produce such reagents are described in WO10/133828. TCRs of the invention may be used as therapeutic reagents. In this case the TCRs may be in soluble form and may preferably be fused to an immune effector. Suitable immune effectors include but are not limited to, cytokines, such as IL-2 and IFN-γ; superantigens and mutants thereof; chemokines such as IL-8, platelet factor 4, melanoma growth stimulatory protein; antibodies, including fragments, derivatives and variants thereof, that bind to antigens on immune cells such as T cells or NK cell (e.g. anti-CD3, anti-CD28 or anti-CD16); and complement activators.

In a further aspect, the invention provides nucleic acid encoding the TCR of the invention, a TCR expression vector comprising nucleic acid encoding a TCR of the invention, as well as a cell harbouring such a vector. The nucleic acid may be cDNA. The TCR may be encoded either in a single open reading frame or two distinct open reading frames. Also included in the scope of the invention is a cell harbouring a first expression vector which comprises nucleic acid encoding an alpha chain of a TCR of the invention, and a second expression vector which comprises nucleic acid encoding a beta chain of a TCR of the invention. Alternatively, one vector may encode both an alpha and a beta chain of a TCR of the invention.

Such a nucleic acid molecule can be synthesised in accordance with methods known in the art. Due to the degeneracy of the genetic code, one of ordinary skill in the art will appreciate that nucleic acid molecules of different nucleotide sequence can encode the same amino acid sequence.

The invention provides a vector comprising a nucleic acid sequence according to the invention. The vector may include, in addition to a nucleic acid sequence encoding only a polypeptide of the invention, one or more additional nucleic acid sequences encoding one or more additional polypeptides. Such additional polypeptides may, once expressed, be fused to the N-terminus or the C-terminus of the polypeptide of the invention. The vector may include a nucleic acid sequence encoding a peptide or protein tag such as, for example, a biotinylation site, a FLAG-tag, a MYC-tag, an HA-tag, a GST-tag, a Strep-tag or a poly-histidine tag.

Suitable vectors are known in the art as is vector construction, including the selection of promoters and other regulatory elements, such as enhancer elements. The vector utilised in the context of the present invention desirably comprises sequences appropriate for introduction into cells. For instance, the vector may be an expression vector, a vector in which the coding sequence of the polypeptide is under the control of its own cis-acting regulatory elements, a vector designed to facilitate gene integration or gene replacement in host cells, and the like.

In the context of the present invention, the term "vector" encompasses a DNA molecule, such as a plasmid, bacteriophage, phagemid, virus or other vehicle, which contains one or more heterologous or recombinant nucleotide sequences (e.g., an above-described nucleic acid molecule of the invention, under the control of a functional promoter and, possibly, also an enhancer) and is capable of functioning as a vector in the sense understood by those of ordinary skill in the art. Appropriate phage and viral vectors include, but are not limited to, lambda (λ) bacteriophage, EMBL bacteriophage, simian virus 40, bovine papilloma virus, Epstein-Barr virus, adenovirus, herpes virus, vaccinia virus, Moloney murine leukemia virus, Harvey murine sarcoma virus, murine mammary tumor virus, lentivirus and Rous sarcoma virus.

The invention also provides a cell comprising the vector of the invention. The cell may be an antigen presenting cell and is preferably a cell of the immune system. In particular, the cell may be a specialised antigen presenting cell such as a dendritic cell or a B cell. The cell may be a mammalian cell.

A further aspect of the invention provides a cell displaying on its surface a TCR of the invention. The cell may be a T cell. There are a number of methods suitable for the transfection of T cells with DNA or RNA encoding the TCRs of the invention (see for example Robbins et al., J. Immunol. 2008 May 1;180 (9): 6116-31). T cells expressing the TCRs of the invention are suitable for use in adoptive therapy-based treatment of diseases such as cancers, including those set out herein. As will be known to those skilled in the art there are a number of suitable methods by which adoptive therapy can be carried out (see for example Rosenberg et al., Nat Rev Cancer. 2008 April;8 (4): 299-308).

The TCRs of the invention intended for use in adoptive therapy are generally glycosylated when expressed by the transfected T cells. As is well known, the glycosylation pattern of transfected TCRs may be modified by mutations of the transfected gene (Kuball J et al., J Exp Med. 2009 Feb. 16;206 (2): 463-75).

The binding moiety of the invention may be an antibody. The term "antibody" as used herein refers to immunoglobulin molecules and immunologically active portions of immunoglobulin molecules, i.e., molecules that contain an antigen binding site that specifically binds an antigen, whether natural or partly or wholly synthetically produced. The term "antibody" includes antibody fragments, derivatives, functional equivalents and homologues of antibodies, humanised antibodies, including any polypeptide comprising an immunoglobulin binding domain, whether natural or wholly or partially synthetic and any polypeptide or protein having a binding domain which is, or is homologous to, an antibody binding domain. Chimeric molecules comprising an immunoglobulin binding domain, or equivalent, fused to another polypeptide are therefore included. Cloning and expression of chimeric antibodies are described in EP-A-0120694 and EP-A-0125023. A humanised antibody may be a modified antibody having the variable regions of a non-human, e.g. murine, antibody and the constant region of a human antibody. Methods for making humanised antibodies are described in, for example, U.S. Pat. No. 5,225,539. Examples of antibodies are the immunoglobulin isotypes (e.g., IgG, IgE, IgM, IgD and IgA) and their isotypic subclasses; fragments which comprise an antigen binding domain such as Fab, scFv, Fv, dAb, Fd; and diabodies. Antibodies may be polyclonal or monoclonal. A monoclonal antibody may be referred to herein as "mab".

It is possible to take an antibody, for example a monoclonal antibody, and use recombinant DNA technology to produce other antibodies or chimeric molecules which retain the specificity of the original antibody. Such techniques may involve introducing DNA encoding the immunoglobulin variable region, or the complementary determining regions (CDRs), of an antibody to the constant regions, or constant regions plus framework regions, of a different immunoglobulin (see, for instance, EP-A-184187, GB 2188638A or EP-A-239400). A hybridoma (or other cell that produces antibodies) may be subject to genetic mutation or other changes, which may or may not alter the binding specificity of antibodies produced.

It has been shown that fragments of a whole antibody can perform the function of binding antigens. Examples of binding fragments are (i) the Fab fragment consisting of VL, VH, CL and CH1 domains; (ii) the Fd fragment consisting of the VH and CH1 domains; (iii) the Fv fragment consisting of the VL and VH domains of a single antibody; (iv) the dAb fragment (Ward, E. S. et al., Nature. 1989 October 12;341 (6242): 544-6) which consists of a VH domain; (v) isolated CDR regions; (vi) F (ab') 2 fragments, a bivalent fragment comprising two linked Fab fragments (vii) single chain Fv molecules (scFv), wherein a VH domain and a VL domain are linked by a peptide linker which allows the two domains to associate to form an antigen binding site (Bird et al., Science. 1988 Oct. 21;242 (4877): 423-6; Huston et al., Proc Natl Acad Sci USA. 1988 August;85 (16): 5879-83); (viii) bispecific single chain Fv dimers (PCT/US92/09965) and (ix) "diabodies", multivalent or multispecific fragments constructed by gene fusion (WO94/13804; P. Hollinger et al., Proc Natl Acad Sci USA. 1993 Jul. 15;90 (14): 6444-8). Diabodies are multimers of polypeptides, each polypeptide comprising a first domain comprising a binding region of an immunoglobulin light chain and a second domain comprising a binding region of an immunoglobulin heavy chain, the two domains being linked (e.g. by a peptide linker) but unable to associate with each other to form an antigen binding site: antigen binding sites are formed by the association of the first domain of one polypeptide within the multimer with the second domain of another polypeptide within the multimer (WO94/13804). Where bispecific antibodies are to be used, these may be conventional bispecific antibodies, which can be manufactured in a variety of ways (Hollinger & Winter, Curr Opin Biotechnol. 1993 August;4 (4): 446-9), e.g. prepared chemically or from hybrid hybridomas, or may be any of the bispecific antibody fragments mentioned above. It may be preferable to use scFv dimers or diabodies rather than whole antibodies. Diabodies and scFv can be constructed without an Fc region, using only variable domains, potentially reducing the effects of anti-idiotypic reaction. Other forms of bispecific antibodies include the single chain "Janusins" described in Traunecker et al., EMBO J. 1991 December;10 (12): 3655-9). Bispecific diabodies, as opposed to bispecific whole antibodies, may also be useful because they can be readily constructed and expressed in E. coli. Diabodies (and many other polypeptides such as antibody fragments) of appropriate binding specificities can be readily selected using phage display (WO94/13804) from libraries. If one arm of the diabody is to be kept constant, for instance, with a specificity directed against antigen X, then a library can be made where the other arm is varied and an antibody of appropriate specificity selected. An "antigen binding domain" is the part of an antibody which comprises the area which specifically binds to and is complementary to part or all of an antigen. Where an antigen is large, an antibody may only bind to a particular part of the antigen, which part is termed an epitope. An antigen binding domain may be provided by one or more antibody variable domains. An antigen binding domain may comprise an antibody light chain variable region (VL) and an antibody heavy chain variable region (VH).

The binding moiety may be an antibody-like molecule that has been designed to specifically bind a antigen-MHC complex of the invention. Of particular preference are TCR-mimic antibodies, such as, for example those described in WO2007143104 and Sergeeva et al., Blood. 2011 Apr. 21;117 (16): 4262-72 and/or Dahan and Reiter. Expert Rev Mol Med. 2012 Feb. 24;14: e6.

Also encompassed within the present invention are binding moieties based on engineered protein scaffolds. Protein scaffolds are derived from stable, soluble, natural protein structures which have been modified to provide a binding site for a target molecule of interest. Examples of engineered protein scaffolds include, but are not limited to, affibodies, which are based on the Z-domain of staphylococcal protein A that provides a binding interface on two of its α-helices (Nygren, FEBS J. 2008 June;275 (11): 2668-76); anticalins, derived from lipocalins, that incorporate binding sites for small ligands at the open end of a beta-barrel fold (Skerra, FEBS J. 2008 June;275 (11): 2677-83), nanobodies, and DARPins. Engineered protein scaffolds are typically targeted to bind the same antigenic proteins as antibodies, and are potential therapeutic agents. They may act as inhibitors or antagonists, or as delivery vehicles to target molecules, such as toxins, to a specific tissue in vivo (Gebauer and Skerra, Curr Opin Chem Biol. 2009 June;13 (3): 245-55). Short peptides may also be used to bind a target protein. Phylomers are natural structured peptides derived from bacterial genomes. Such peptides represent a diverse array of protein structural folds and can be used to inhibit/disrupt protein-protein interactions in vivo (Watt, Nat Biotechnol. 2006 February;24 (2): 177-83)].

The inventors have shown that tumours homocitrullinate proteins after in vitro culture. Samples from in vitro cultured B16F1 cells were analysed by ELISA for the level of homocitrullinated proteins. Lysates were also produced from in vitro cultured B16F1 cells and then treated with or without potassium cyanate (KCNO) as a source of cyanate. Carbamylation was significantly increased in cells after incubation with KCNO. This demonstrates that proteins from whole tumour cells can undergo carbamylation in a high cyanate environment, implying that isocyanic acid can cross the cell membrane to induce intracellular carbamylation. Proteins from whole tumour cells can also undergo carbamylation mediated by MDSCs as in vitro studies demonstrated the MPO expressing MDSCs could stimulate carbamylation of B16 tumour cells. Carbamylation of ALDOA and vimentin recombinant proteins was performed by in vitro treatment with KCNO and carbamylation assessed by ELISA. As with the cell lines, carbamylation was significantly increased for both proteins after treatment with KCNO demonstrating that both proteins contain lysines that can be subject to homocitrullination. Subsequently, carbamylated recombinant protein samples were analysed by mass spectrometry to determine the presence of homocitrulline molecules. Mass spectrometry demonstrates that both ALDOA and vimentin proteins can be homocitrullinated at a number of sites including the modifications within the epitopes discussed above namely K87, K140 and K147 in ALDOA and K120 in vimentin. Other sites include in aldolase K13, K14, K28, KI42, K87, K99 K101, K108, K139, K140, K147, K153, K200, K208, K230, K243, K289, K294, K312, K317, K318, K322, K320 and in vimentin K104, K120, K168, K188, K313, K373, K402, K439, K445. B16DP4 tumours were also lysed and analysed by mass spectroscopy for carbamylation of HSP60. Residues K191, K202, K205, K218, K222, K359, K481 and K58 were all carbamylated. Together, these results show that, under the correct conditions, these proteins undergo carbamylation.

As discussed, the inventors have found that certain modified epitopes are associated with tumours and homocitrullinated peptides stimulate T cell responses which can be used to raise an immune response against tumours. The present invention provides an epitope of the first aspect, a complex of the second aspect, and/or a binding moiety of the third aspect for use in medicine, The epitope of the first aspect, complex of the second aspect, and/or binding moiety of the third aspect can be used in a method for treating cancer. Also provided are the use of an epitope of the first aspect, a complex of the second aspect, and/or a binding moiety of the third aspect in the manufacture of a medicament for the treatment of cancer, as well as a method of treating cancer, comprising administering an epitope of the first aspect, a complex of the second aspect, and/or a binding moiety of the third aspect of the invention to a subject in need of such treatment. Epitopes in accordance with the present invention may be used alone or in combination as a pool. In addition, they may be used in combination with other therapeutic agents, such as anti-cancer agents including but not limited to checkpoint blockade drugs such as ipilimumab, pembrolizumab and Nivolumab.

The inventors are the first to show that homocitrullinated peptides can stimulate potent T cell responses. The invention provides suitable means for local stimulation of an immune response directed against tumour tissue in a subject. The homocitrullinated responses are CD4 mediated in recognition of the modified epitopes with no cross reactivity against the wild type, unmodified peptide. The CD4 responses stimulated are generally Th1 with minimal IL-10 being produced. The CD4 mediated response can be abrogated in the presence of CD4 but not with a CD8 blocking antibody. The homocitrullinated responses can also be CD8 mediated in recognition of the modified epitopes with no cross reactivity against the wild type, unmodified peptide. The CD8 mediated response can be abrogated in the presence of CD8 but not with a CD4 blocking antibody. T cells specific for these Hcit peptides could target tumour cells to elicit strong anti-tumour effects in vivo, thus providing the first evidence for the use of Hcit epitopes as vaccine targets for cancer therapy. Stimulation of an immune response directed against a vaccine target includes the natural immune response of the patient and immunotherapeutic treatments aiming to direct the immune response against the tumour (e.g. checkpoint inhibitors, CAR-Ts against tumour antigens and other tumour immunotherapies). Such support or induction of the immune response may in various clinical settings be beneficial in order to initiate and maintain the immune response and evade the tumour-mediated immunosuppression that often blocks this activation. These responses may be tolerised for the treatment of autoimmune diseases.

All peptides inhibited the binding of biotinylated Hep B to HLA-DP4 but to varying levels. Aldolase A 74-93Hcit, Aldolase A 140-157 Hcit, Aldolase A 217-235 Hcit, Aldolase A 238-256 Hcit, Cyk8 101-120 Hcit, Cyk8 112-131 Hcit, Cyk8 182-202 Hcit, Cyk8 371-388 Hcit and Cyk8 281-399 Hcit all showed more than 60% inhibition. These results teach that TCRs that recognise HLA-DP4 complexed with any of these peptides would be useful for tumour therapy.

In some embodiments, the cellular immune response is specific for the stress induced post-translationally modified peptide wherein immune response includes activation of T cells expressing TCRαβ or γδ. The present invention relates to TCRs, individual TCR subunits (alone or in combination), and subdomains thereof, soluble TCRs (sTCRs), for example, soluble αβ dimeric TCRs having at least one disulphide inter-chain bond between constant domain residues that are not present in native TCRs, and cloned TCRs, said TCRs engineered into autologous or allogeneic T cells or T cell progenitor cells, and methods for making same, as well as other cells bearing said TCR.

The cancer may be breast cancer including oestrogen receptor negative breast cancer, colorectal cancer, gastric cancer, non-small cell lung cancer, ovarian cancer including endometrial carcinoma, pancreatic cancer including pancreatic ductal adenocarcinoma, leukaemia, melanoma, renal cancer head and neck cancer or lung cancer. The cancer may be Burkitt's lymphoma, chronic lymphocytic leukaemia, pancreatic adenocarcinoma, colon cancer, acute lymphoblastic leukaemia or acute myeloid leukaemia.

The present invention provides pharmaceutical composition comprising an epitope of the present invention be formulated with an adjuvant or other pharmaceutically acceptable vaccine component. In particular embodiments, the adjuvant is a TLR ligand such as CpG (TLR9) MPLA (TLR4), imiquimod (TLR7), poly I: C (TLR3) or amplivant TLR1/2 ligand, GMCSF, an oil emulsion, a bacterial product or whole inactivated bacteria As used herein, the term "treatment" includes any regime that can benefit a human or non-human animal. The polypeptide moiety may be employed in combination with a pharmaceutically acceptable carrier or carriers to form a pharmaceutical composition. Such carriers may include, but are not limited to, saline, buffered saline, dextrose, liposomes, water, glycerol, ethanol and combinations thereof.

It is envisaged that injections will be the primary route for therapeutic administration of the compositions of the invention although delivery through a catheter or other surgical tubing may also be used. Some suitable routes of administration include intravenous, subcutaneous, intradermal, intraperitoneal and intramuscular administration. Liquid formulations may be utilised after reconstitution from powder formulations.

For intravenous injection, or injection at the site of affliction, the active ingredient will be in the form of a parentally acceptable aqueous solution which is pyrogen-free, has suitable pH, is isotonic and maintains stability. Those of relevant skill in the art are well able to prepare suitable solutions using, for example, isotonic vehicles such as sodium chloride injection, Ringer's Injection or Lactated Ringer's Injection. Preservatives, stabilisers, buffers, antioxidants and/or other additives may be included, as required.

Pharmaceutical compositions for oral administration may be in tablet, capsule, powder or liquid form. A tablet may comprise a solid carrier such as gelatin or an adjuvant. Liquid pharmaceutical compositions generally comprise a liquid carrier such as water, petroleum, animal or vegetable oils, mineral oil or synthetic oil. Physiological saline solution, dextrose or other saccharide solution or glycols such as ethylene glycol, propylene glycol or polyethylene glycol may be included. Where the formulation is a liquid it may be, for example, a physiologic salt solution containing non-phosphate buffer at pH 6.8-7.6, or a lyophilised powder.

The composition may be administered in a localised manner to a tumour site or other desired site or may be delivered in a manner in which it targets tumour or other cells. In some embodiments, the peptides are administered without an adjuvant for a cellular immune response including activation of T cells expressing TCRαβ or γδ.

The compositions are preferably administered to an individual in a "therapeutically effective amount", this being sufficient to show benefit to the individual. The actual amount administered, and rate and time-course of administration, will depend on the nature and severity of what is being treated. Prescription of treatment, e.g. decisions on dosage etc, is within the responsibility of general practitioners and other medical doctors, and typically takes account of the disorder to be treated, the condition of the individual patient, the site of delivery, the method of administration and other factors known to practitioners. The compositions of the invention are particularly relevant to the treatment of cancer, and in the prevention of the recurrence of such conditions after initial treatment or surgery. Examples of the techniques and protocols mentioned above can be found in Remington's Pharmaceutical Sciences (Remington 1980). A composition may be administered alone or in combination with other treatments, either simultaneously or sequentially dependent upon the condition to be treated. Other cancer treatments include other mAbs, other chemotherapeutic agents, other radiotherapy techniques or other immunotherapy known in the art. One particular application of the compositions of the invention is as an adjunct to surgery, i.e. to help to reduce the risk of cancer reoccurring after a tumour is removed. The compositions of the present invention may be generated wholly or partly by chemical synthesis. The composition can be readily prepared according to well-established, standard liquid or, preferably, solid-phase peptide synthesis methods, general descriptions of which are broadly available (see, for example, in Solid Phase Peptide Synthesis, 2nd edition (Stewart 1984), in The Practice of Peptide Synthesis (Bodanzsky 1984) and Applied Biosystems 430A User's Manual, ABI Inc., or they may be prepared in solution, by the liquid phase method or by any combination of solid-phase, liquid phase and solution chemistry, e.g. by first completing the respective peptide portion and then, if desired and appropriate, after removal of any protecting groups being present, by introduction of the residue X by reaction of the respective carbonic or sulfonic acid or a reactive derivative thereof.

The epitopes, complexes, nucleic acid molecules, vectors, cells and binding moieties of the invention may be non-naturally occurring and/or purified and/or engineered and/or recombinant and/or isolated and/or synthetic.

It is preferred if the epitope of the invention comprises, consists essentially of, or consists of a sequence selected from:

```
                                                       (SEQ ID NO: 3)
NYID-Hcit-VRFLEQQN-Hcit-ILLAEL (Vimentin 116-135 Hcit)

(SEQ ID NO: 11)
DVRQQYESVAA-Hcit-NLQEAE (Vimentin 271-288 Hcit)

(SEQ ID NO: 12)
EAEEWY-Hcit-S-Hcit-FADLSEAANRN (Vimentin 286-305 Hcit)

(SEQ ID NO: 15)
IGGVILFHETLYQ-Hcit-ADDGRP (ALDOA 74-93 Hcit)

(SEQ ID NO: 16)
Hcit-DGADFA-Hcit-WRCVL-Hcit-IGEH (ALDOA 140-157 Hcit)

(SEQ ID NO: 18)
HACTQ-Hcit-FSHEEIAMATVTA (ALDOA 238-256 Hcit)

(SEQ ID NO: 25)
KFASFID-Hcit-VRFLEQQN-Hcit-MLE (Cytokeratin 101-120 Hcit)

(SEQ ID NO: 26)
LEQQN-hcit-MLET-hcit-WSLLQQQ-hcit-T (Cytokeratin 112-131 Hcit)

(SEQ ID NO: 27)
Hcit-MLET-Hcit-WSL (Cytokeratin 8 117-125)

(SEQ ID NO: 28)
EIN-hcit-RTEMENEFVLI-hcit-hcit-DVDE (Cytokeratin 182-202 Hcit)
```

```
                                                     (SEQ ID NO: 29)
LREYQELMNV-hcit-LALDIEI (Cytokeratin 371-388 Hcit)

(SEQ ID NO: 30)
hcit-LALDIEIATYR-hcit-LLEGEE (Cytokeratin 381-399 Hcit)

(SEQ ID NO: 13)
FSLADAINTEF-Hcit-NTRTNE-Hcit-VELQ (Vimentin 86-108 Hcit)

(SEQ ID NO: 14)
Hcit-MALDIEIATYR-Hcit-LLEGEE (Vimentin 390-408 Hcit)

(SEQ ID NO: 23)
YVTE-Hcit-VLAAVY-Hcit-ALSD (Aldolase 204-219 Hcit)

(SEQ ID NO: 24)
VLAAVY-Hcit-AL (Aldolase 209-217)

(SEQ ID NO: 20)
DL-Hcit-RCQYVTE-Hcit-VLAAVY-Hcit-A (Aldolase 198-216 Hcit)

(SEQ ID NO: 42)
EDFSETLTRA-Hcit-FEELNMDLFR (BiP 316-336 Hcit)

(SEQ ID NO: 43)
EELNMDLFRSTM-Hcit-PVQ-Hcit-VL (BiP 328-346 Hcit)

(SEQ ID NO: 46)
RNELESYAYSL-Hcit-NQIGD-Hcit- (BiP 562-579 Hcit)

(SEQ ID NO: 48)
PLRPQNYLFGCEL-Hcit-AD-Hcit- (NPM 11-27 Hcit)

(SEQ ID NO: 52)
GGSLP-Hcit-VEA-Hcit-FINYV-Hcit-NCFR (NPM 258-277 Hcit)

(SEQ ID NO: 53)
A-Hcit-FINYV-Hcit-NCFRMTDQEAIQDL (NPM 266-287 Hcit)

(SEQ ID NO: 57)
GSHAGN-Hcit-LAMQEFMILPVGAA (Alpha enolase 156-176 Hcit)

(SEQ ID NO: 60)
DVAASEFFRSG-Hcit-YDLDF-Hcit-SP (Alpha enolase245-264 Hcit)

(SEQ ID NO: 64)
RSERLA-Hcit-YNQLLRIEEELGS (Alpha enolase 400-419 Hcit)

(SEQ ID NO: 78)
TVLARSIA-Hcit-EGFE-Hcit-IS-Hcit-GAN (HSP60 117-136 Hcit)
```

The invention also provides a method of identifying a binding moiety that binds a complex of the invention, the method comprising contacting a candidate binding moiety with the complex and determining whether the candidate binding moiety binds the complex.

Preferred features of each aspect of the invention are as for each of the other aspects mutatis mutandis. The prior art documents mentioned herein are incorporated to the fullest extent permitted by law.

EXAMPLES

The present invention will now be described further with reference to the following examples and the accompanying drawings.

FIG. 1: Chemical reaction conversion of lysine to Hcit (Jaisson, Pietrement, and Gillery 2011) Increased urea or breakdown of thiocyanate leads to accumulation of cyanate and increased carbamylation of lysine forming Hcit residues.

FIG. 2: Sequence logo representation of the binding motifs for HLA-DR, HLA-A and HLA-B molecules a: Sequence logo representation of the binding motifs for 6 HLA-DR molecules using NNAlign. On the positive y-axis, the amino acids enriched at each peptide position and on the negative y-axis the corresponding depleted amino acids. MHC class II DR molecules have a binding motif with interactions at P1, P4, P6 and P9. The height of a column in the sequence logo indicates the importance of a certain position in defining the motif, and the height of each letter in the column the amino acid preference at that position (Andreatta et al. 2011). Sequence logos are calculated using the WebLogo program (Crooks et al. 2004).b: Sequence logo representation of the binding motifs for 5 HLA-A molecules using NetMHCpan. On the positive y-axis, the amino acids enriched at each peptide position and on the negative y-axis the corresponding depleted amino acids. MHC class I A molecules have a binding motif with interactions at P2 and P9. The height of a column in the sequence logo indicates the importance of a certain position in defining the motif, and the height of each letter in the column the amino acid preference at that position (Andreatta et al. 2011). c: Sequence logo representation of the binding motifs for 4 HLA-B molecules using NetMHCpan. On the positive y-axis, the amino acids enriched at each peptide position and on the negative y-axis the corresponding depleted amino acids. MHC class I B molecules have a binding motif with interactions at P2 and P9. The height of a column in the sequence logo indicates the importance of a certain position in defining the motif, and the height of each letter in the column the amino acid preference at that position (Andreatta et al. 2011).

FIG. 3: Sequences of human aldolase, vimentin, cytokeratin 8, BiP, NPM, alpha-Enolase, βcatenin and HSP60
  a: Amino acid sequence of human Aldolase
  Aldolase (also known as Fructose-bisphosphate ALDOA) is a glycolytic enzyme. Vertebrates encode three forms of this enzyme; ALDOA A encoded by ALDOA is expressed predominantly in muscle, ALDOA B (ALDOB) in liver and ALDOA C (ALDOC) in the brain. The sequences alignment was performed for ALDOA, ALDOB and ALDOC.
  b: Amino acid sequence of human ALDOA A
  c: Amino acid sequence of human vimentin
  d: Amino acid sequence of human Cytokeratin 8
  e: Amino acid sequence of human BiP
  f: Amino acid sequence of human NPM
  g: Amino acid sequence of human alpha-enolase
  h: Amino acid sequence of human β-catenin
  i: Amino acid sequence of human HSP60

Figure 4:
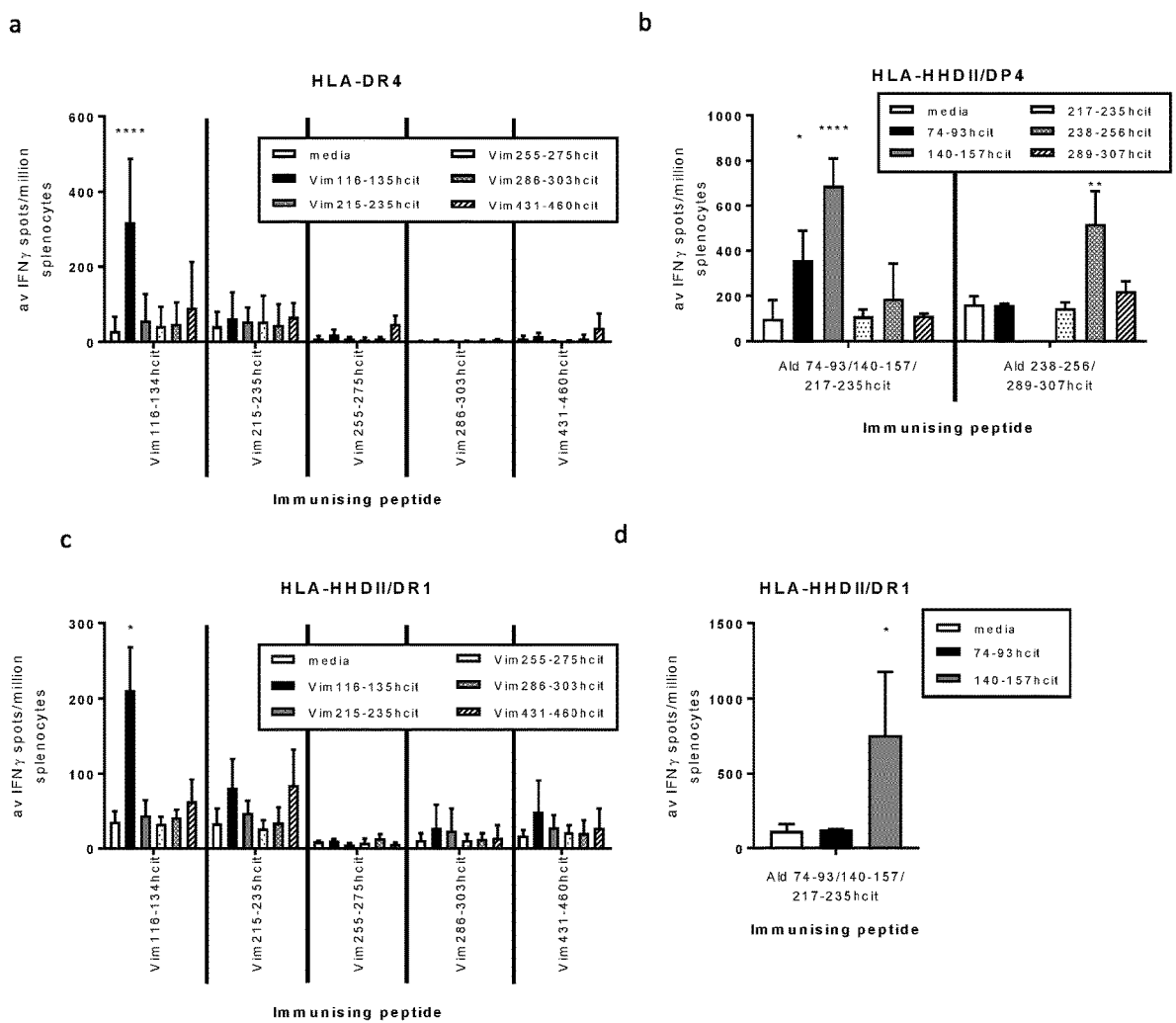

FIG. 4: Screening of IFNγ ELISpot responses generated by peptides containing homocitrulline residues
Transgenic HLA-DR4, HLA-HHDII/DR1 or HLA-HHDII/DP4 mice were screened for responses to peptides containing homocitrulline residues. All mice received 3 doses of peptides with CpG/MPLA as an adjuvant. IFNγ responses were then assessed by ex vivo ELISpot. Responses to vimentin peptides containing Hcit were seen in HLA-DR4 (a) and HLA-HHDII/DR1 (c) mice. Responses to ALDOA peptides containing Hcit were seen in HLA-HHDII/DP4 (b) and HLA-HHDII/DR1 (d) mice. Statistical analysis was performed, p values are represented as * $p<0.05$,  $p<0.01$, * $p<0.001$, *$p<0.0001$.

Figure 5:
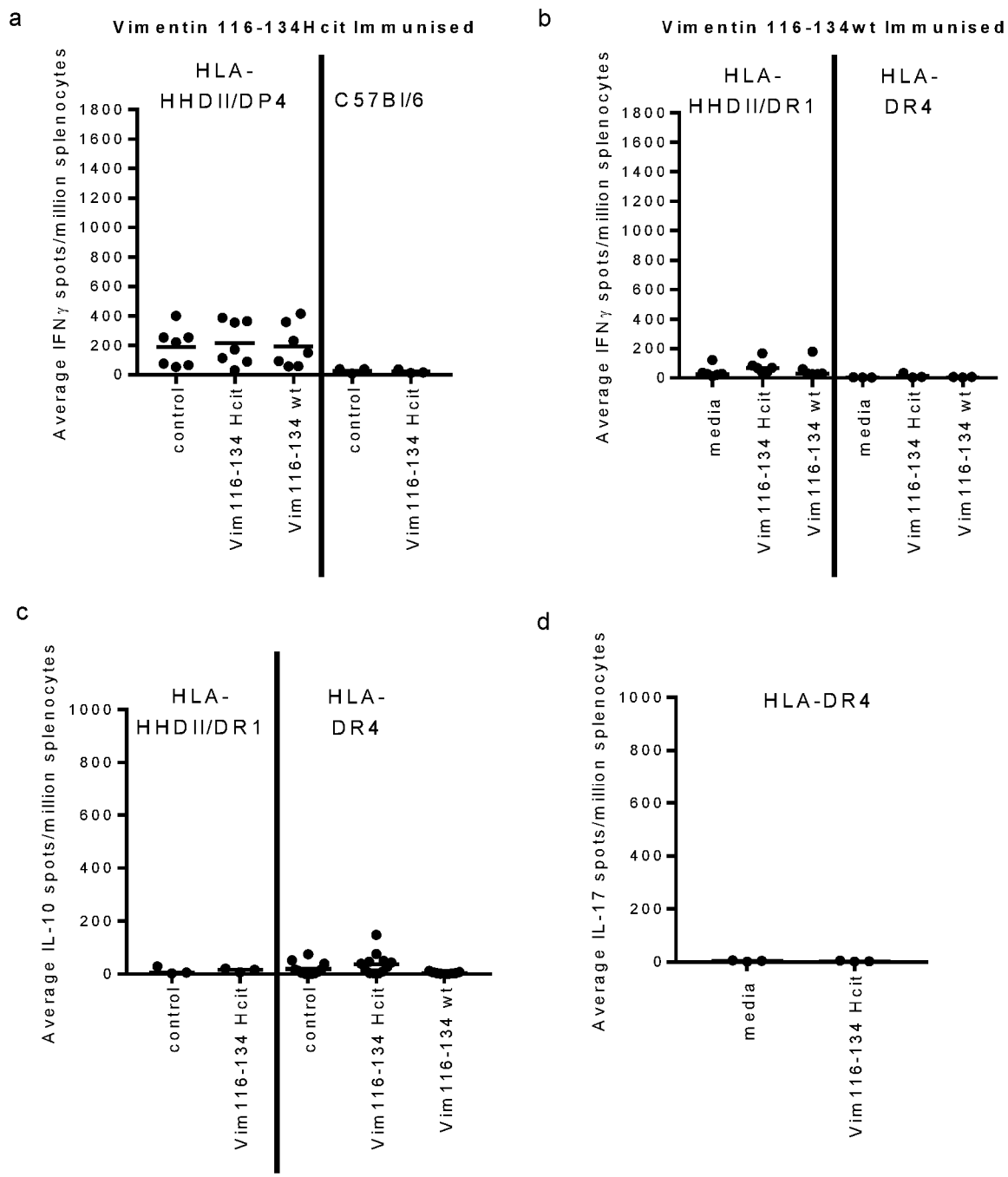

FIG. 5: IFNγ responses to vimentin are strain-specific
Ex vivo IFNγ ELISpot responses to vimentin 116-134 Hcit peptide were also assessed in HLA-HHDII/DP4 and C57Bl/6 mice (a). Responses to vimentin 116-134 wt peptide were assessed in HLA-HHDII/DR1 and HLA-DR4 mice (b). In addition, IL-10 (c) and IL-17 (d) responses were in response to vimentin 116-135 Hcit peptides were determined. For all studies mice were immunised with three doses of peptide with CpG/MPLA as an adjuvant and responses were assessed at day 21. None of the responses were statistically significant.

FIG. 6: IFNγ responses to ALDOA are strain-specific
Ex vivo IFNγ ELISpot responses to ALDOA 74-93 Hcit and ALDOA 140-157 Hcit were assessed in HLA-DR4 mice (a). Ex vivo ELISpot was also used to assess IL-10 (b) and IL-17 (c) responses to ALDOA peptides in HLA-HHDII/DP4 mice. For all studies mice were immunised with three doses of peptide with CpG/MPLA as an adjuvant and responses were assessed at day 21. Significant p values are shown for peptide compared to media only control stimulation.

Figure 7:
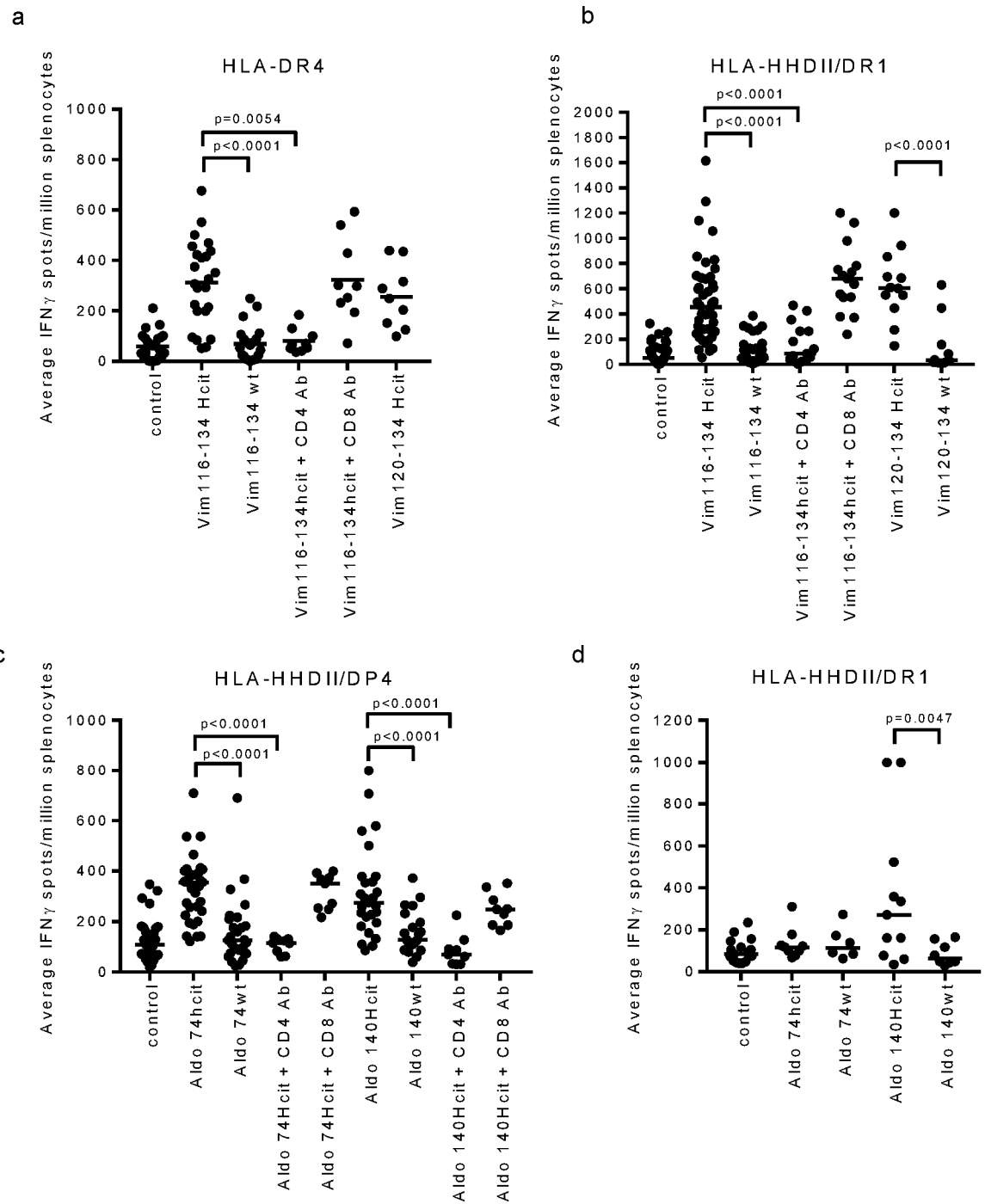

FIG. 7: Characterisation of Hcit-specific IFNγ responses in mice
IFNγ ELISpot responses in splenocytes from mice immunised with vimentin 116-135 Hcit peptide were assessed in transgenic HLA-DR4 (a) and HLA-HHDII/DR1 (b) mice. Responses in mice immunised with ALDOA 74-93 Hcit and ALDOA 140-157 Hcit peptides were assessed in transgenic HLA-HHDII/DP4 (c) and HLA-HHDII/DR1 (d) mice. The wt peptides were included as controls. Mice were given three immunisations of peptides with CpG/MPLA and spleens were harvested on day 21. Splenocytes were restimulated with peptides alone or with peptides in combination with anti-CD4 or anti-CD8 blocking antibodies. Significant p values are shown for Hcit peptides compared to wt peptides and to peptide plus blocking antibodies.

FIG. 8: Sequence alignment T cell epitopes containing homocitrulline for different species
Alignment of Hcit T cell epitopes from human vimentin (a), ALDOA (b), enolase (c), Bip (d), β-catenin (e), Cyk8 (f) and NPM (g) and HSP60 (h) subunit with equivalent sequences from other species (Mouse, Rat, Cow (Bovine), Pig, Horse, Cat, Dog, Rabbit and Sheep) depicting homology.

FIG. 9: In vitro carbamylation of vimentin and ALDOA
B16F1 cells or recombinant vimentin or recombinant ALDOA A protein were carbamylated by incubation in the presence of potassium cyanate (KCNO). Carbamylation was then assessed using carbamylation ELISA (a). P values are shown compared untreated to treated samples. Error bars show standard deviation. Carbamylated recombinant proteins were assessed by mass spectrometry on a SCIEX 6600 TripleTof mass spectrometer via a Duospray (TurboV) source with a 50 um electrode and lysine residues from ALDOA (b) or vimentin (c) were assessed for the carbamylation modification.

Figure 10:
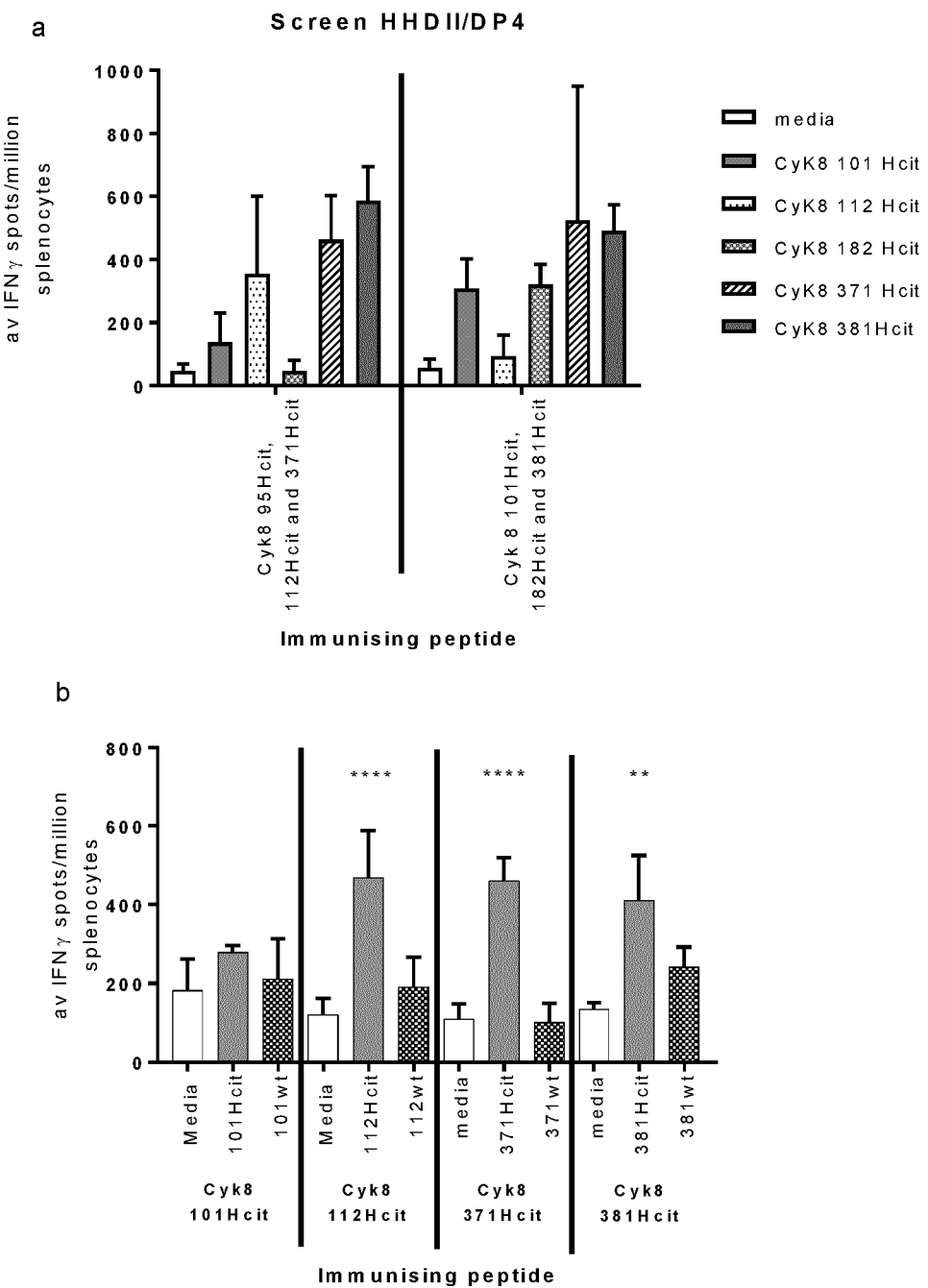

FIG. 10: Screening of IFNγ ELISpot responses to cytokeratin 8 (Cyk8) peptides
Transgenic HLA-HHDII/DP4 mice were screened for responses to pools of Hcit Cyk8 peptides containing homocitrulline residues. All mice received 3 doses of peptides with CpG/MPLA as an adjuvant. IFNγ responses were then assessed by ex vivo ELISpot (a). Responses to Cyk8 101Hcit, 112Hcit, 371Hcit and 381Hcit were assessed for wild type cross reactivity after 3 immunisations (b). Statistical analysis was preformed, p values are represented as * $p<0.05$,  $p<0.01$, * $p<0.001$, **** $p<0.0001$ FIG. 11: Characterisation of Cytokeratin 8 (Cyk8) Hcit peptide responses in HHDII/DP4 mice
HHDII/DP4 mice were immunised with individual Hcit peptides. Ex vivo ELISpot were then performed on day 21. Splenocytes were restimulated with media, hcit peptide, wild type (wt) peptides, or Hcit peptides in the presence of CD4/CD8 blocking antibodies (a-b, d-e). Immunisation with the shorter Cy8 117Hcit peptide also induced an immune response (f).

FIG. 12: Characterisation of Cytokeratin 8 (Cyk8) Hcit peptide responses in HHDII/DR1 mice HHDII/DR1 mice were immunised with pooled peptides ex vivo ELISpot were then performed on day 21 to screen for responses (a). Mice were then immunised with individual Hcit peptides (b-d) or wt peptides (e). In ELISpots splenocytes were restimulated with media, hcit peptide, wild type (wt) peptides, or Hcit peptides in the presence of CD4/CD8 blocking antibodies.

FIG. 13: Screening of IFNγ ELISpot responses generated by peptides containing homocitrulline residues in HLA-HHDII/DP4 mice
Transgenic HLA-HHDII/DP4 mice were screened for responses to peptides containing homocitrulline residues that were selected based spiral shape and predicted HLA-DP4 binding. All mice received 3 doses of peptides with CpG/MPLA as an adjuvant. IFNγ responses were then assessed by ex vivo ELISpot. Responses to Bip (a), Enolase (b), NPM (c), Vimentin (d) and aldolase (e and f) peptides containing Hcit were seen. Responses to Hcit aldolase peptides (e and f) were assessed for responses in the presence of CD4 or CD8 blocking antibodies and for cross reactivity to wildtype (wt) peptides.

Figure 14:
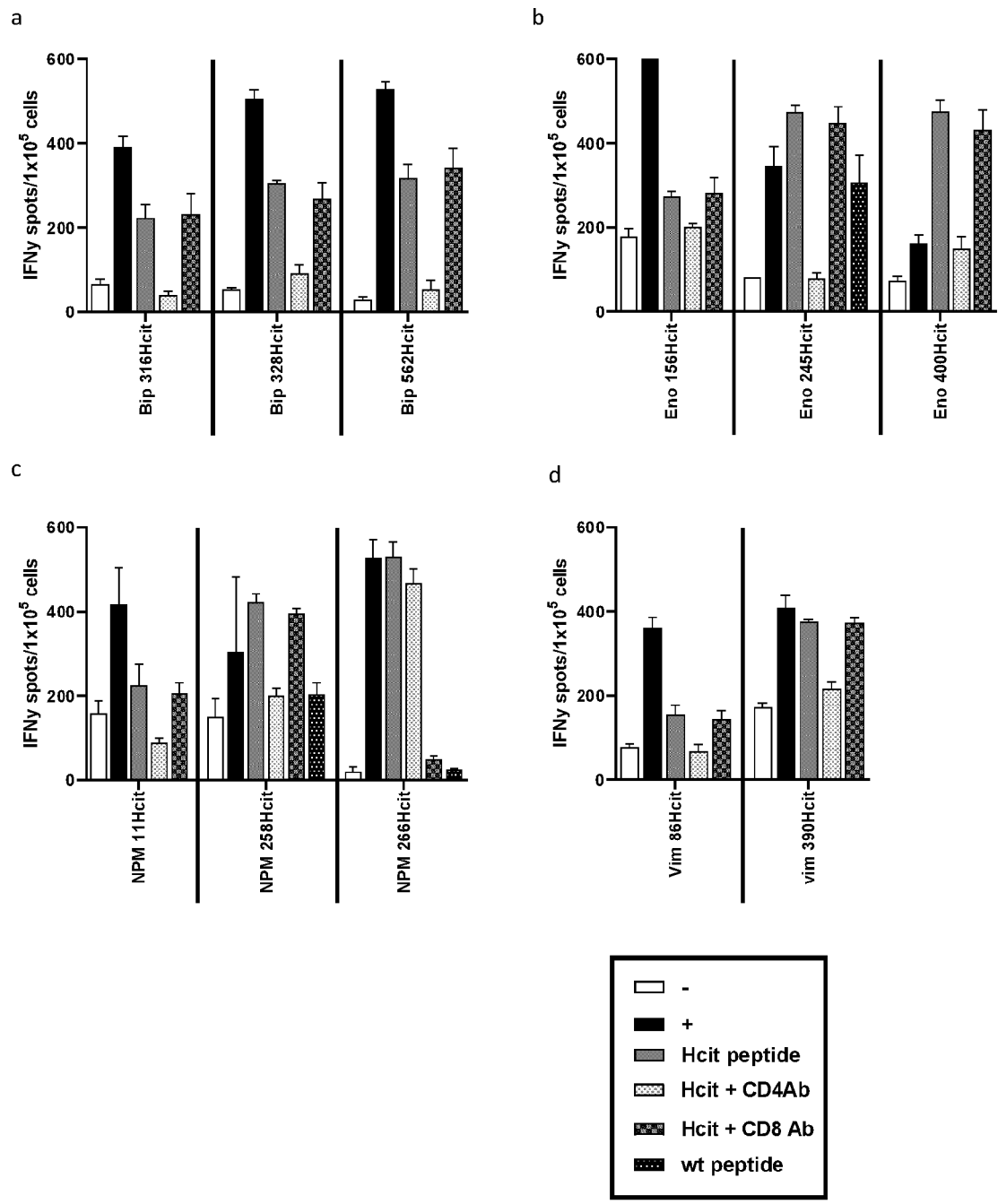

FIG. 14: Responses to Homoctirullinated peptides can be cultured

Splenocytes from transgenic HLA-HHDII/DP4 mice immunised with Hcit peptides were then grown ex vivo in the presence of Hcit peptides. IFNγ responses were then reassessed by ELISpot. Responses to Bip (a), Enolase (b), NPM (c) and Vimentin (d) peptides containing Hcit were seen. Responses were also assessed in the presence of CD4 or CD8 blocking antibodies and for cross reactivity to wildtype (wt) peptides.

Figure 15:
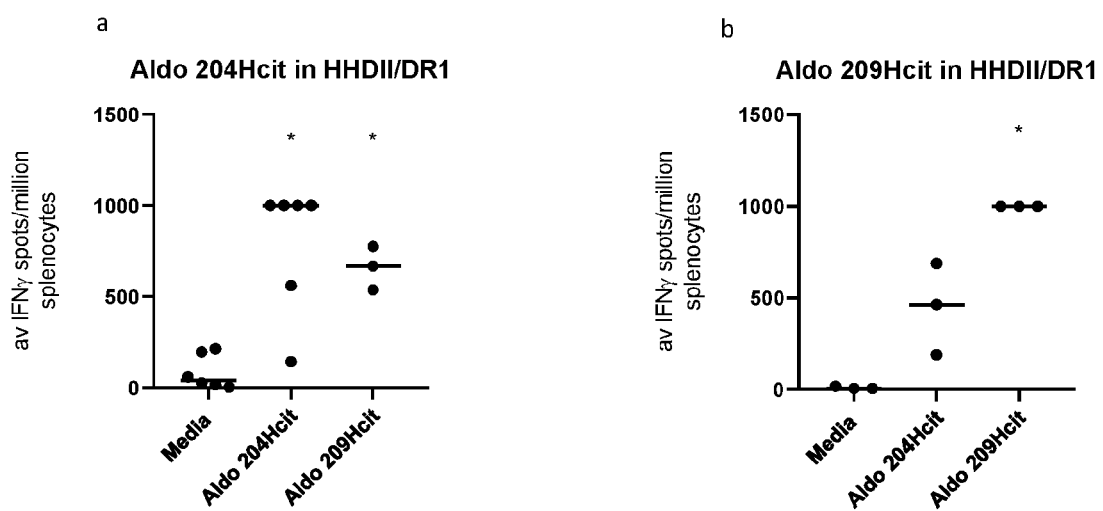

FIG. 15: Screening of IFNγ ELISpot responses generated by peptides containing homocitrulline residues in HLA-HHDII/DR1 mice Transgenic HLA-HHDII/DR1 mice were screened for responses to aldolase peptides containing homocitrulline residues that demonstrated responses in HHDII/DP4 mice. All mice received 3 doses of peptides with CpG/MPLA as an adjuvant. IFNγ responses were then assessed by ex vivo ELISpot. Responses to Aldolase 204 Hcit (A) and the shorter Aldolase 209hcit (B) peptide were assessed.

FIG. 16: Humans have a repertoire for Hcit peptides

PBMCs were isolated from 14 healthy donors and 11 cancer patients and assessed for responses to Hcit peptides by CFSE proliferation assays. PBMCs were CD25-depleted and then CFSE-labelled and stimulated with 10 µg/ml of peptides. Proliferation was assessed on day 10. Example plots are shown for healthy donor BD0051 (A) and lung cancer patient LG10 (B). Summary graphs show that the majority of peptide-induced proliferation is found in the CD4+ cells for both healthy donors (C) and patients (D). CD4 proliferation in each donor was assessed in comparison to the media control for healthy donors (E) and cancer patients (F).

FIG. 17: Analysis of cytokine expression performed on donors

Example plots from patient LG10 showing staining for IFNγ, GraB and CD134 on the proliferating CFSE$^{low}$ CD4+ population after stimulation with peptides for 10 days (A). Summary of flow cytometry data showing the percentage of proliferating CD4+ cells which express GraB, CD134 and IFNγ among the healthy donor (B) and patient (C) responders who showed proliferation following peptide stimulation.

Figure 18:
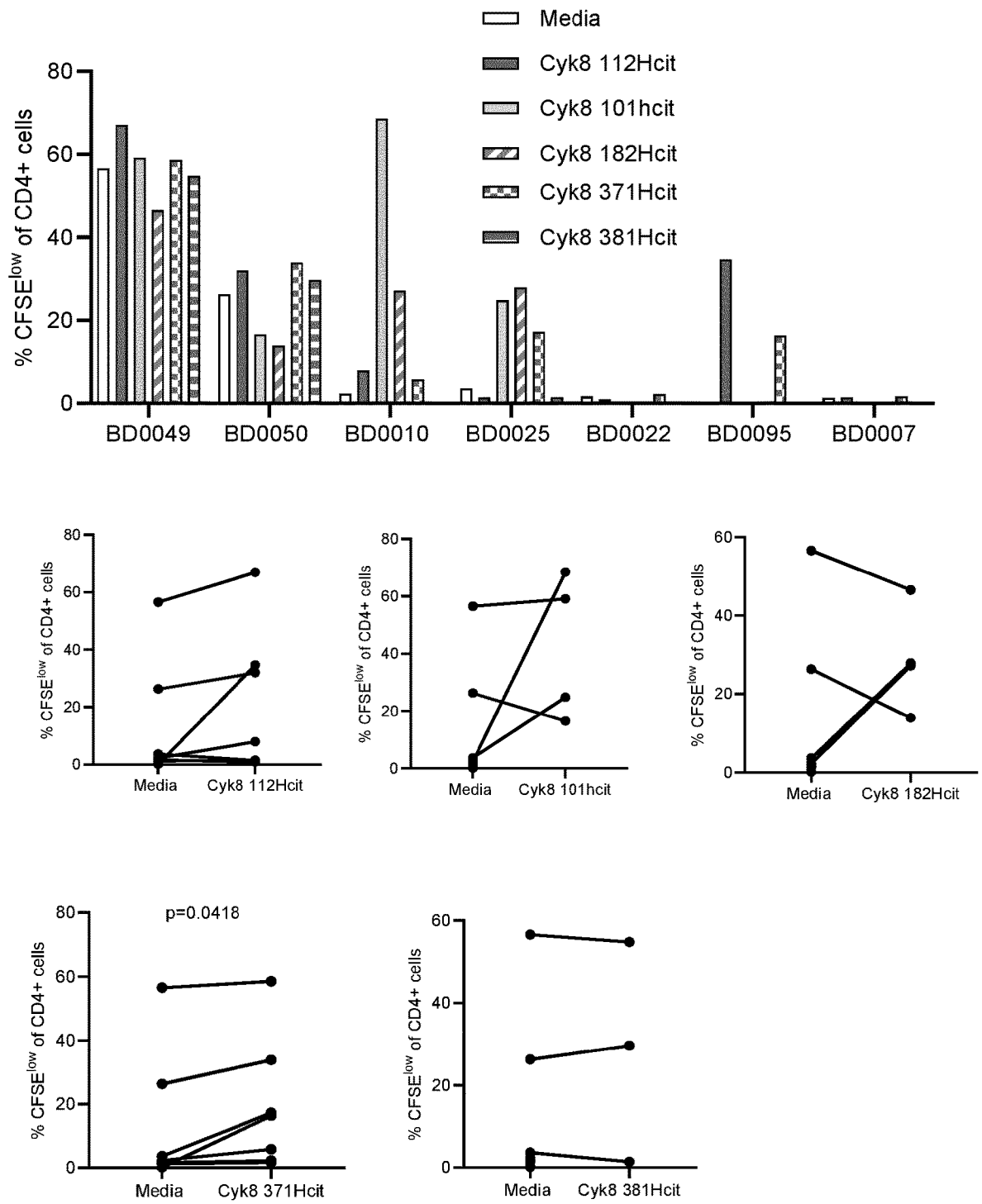

FIG. 18: Humans have a repertoire for Cyk8 Hcit peptides

PBMCs were isolated from 7 healthy donors and assessed for responses to Hcit peptides by CFSE proliferation assays. PBMCs were CD25-depleted and then CFSE-labelled and stimulated with 10 µg/ml of peptides. Proliferation was assessed on day 10.

FIG. 19: Increase survival in mice immunised with Hcit peptides

In vivo tumour survival studies were carried out by implanting mice with HLA matched transgenic B16F1 cells s.c. on the right flank on day 1. On day 4, 11 and 18 mice were immunised with peptide with CpG/MPLA. Tumour growth was assessed after immunisation with vimentin 116-135 Hcit in HLA-HHDII/DR1 (a) or HLA-DR4 mice (b). Tumour growth after immunisation with ALDOA peptides were assessed in HLA-HHDII/DP4 (c) and HLA-HHDII/DR1 (d) mice. Tumour growth was also assessed after immunisation with vimentin 116-135 Hcit in HLA-DR4 mice implanted with B16F1 with an IFNγ inducible DR4 cell line (e). Statistical analysis was performed comparing survival in immunised mice to survival in control mice, significant p values are shown.

Figure 20:
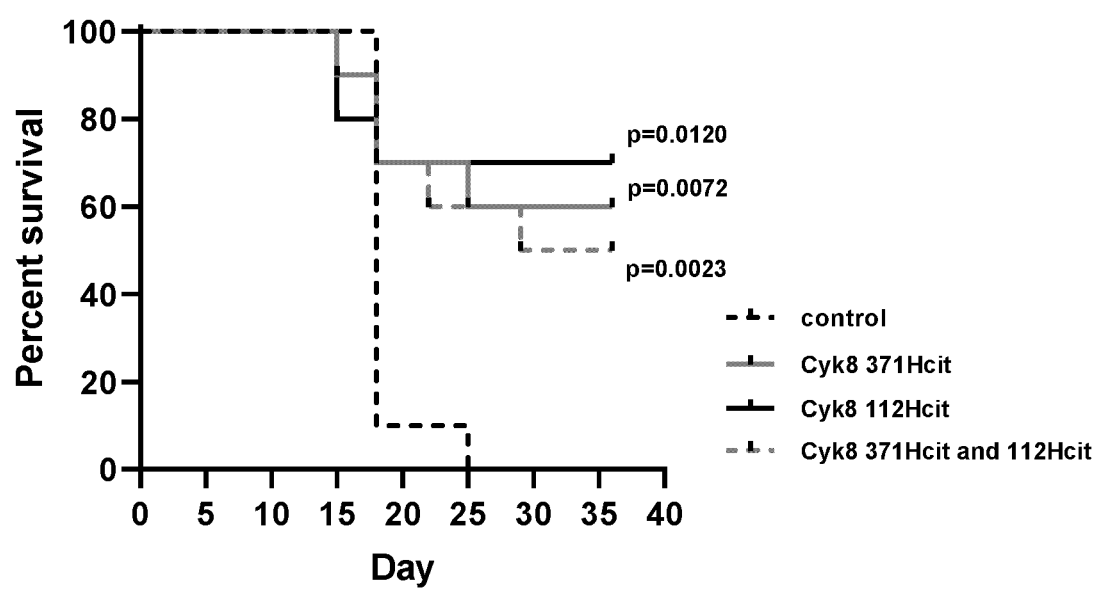

FIG. 20: Increase survival in mice immunised with Cyk8 Hcit peptides

In vivo tumour survival studies were carried out by implanting mice with HLA matched transgenic B16F1 cells s.c. on the right flank on day 1. On day 4, 11 and 18 mice were immunised with peptide with CpG/MPLA. Tumour growth was assessed after immunisation with Cyk8 Hcit peptides in HLA-HLA-HHDII/DR1 mice.

FIG. 21: Increased survival in mice immunised with Hcit peptides in IFNγ inducible HLA tumour models In vivo tumour survival studies were carried out by implanting HLA-DP4 transgenic mice with HLA matched transgenic B16F1 cells s.c. on the right flank on day 1 where HLA is under the control of IFNγ inducible promoter. On day 4, 11 and 18 mice were immunised with peptide with CpG/MPLA. Tumour growth was assessed after immunisation with Cyk8 371Hcit peptide (a) or Bip 562Hcit peptide (b), Vimentin86Hcit, NPM 266Hcit or Enolase 156Hcit in HLA-HHDII/DP4.

FIG. 22: MPO is produced by MDSCs in the anti-tumour environment

Flow cytometry was used to assess MPO expression on B16F1 cells (a) or CD45+tumour-infiltrating cells (b). Spleen, blood and tumour cells were stained to determine expression of MPO on CD45+ cells (c). The proportion of MPO+ cells which express G-MDSC (Ly6G+Ly6C$^{low}$) or M-MDSC (Ly6G-Ly6C$^{high}$) markers was assessed in the spleen and tumour (d). Tumour infiltrating MPO+ cells from the Ly6G-Ly6C$^{high}$ population were assessed for CD115 and F4/80 expression (d).

Figure 23:
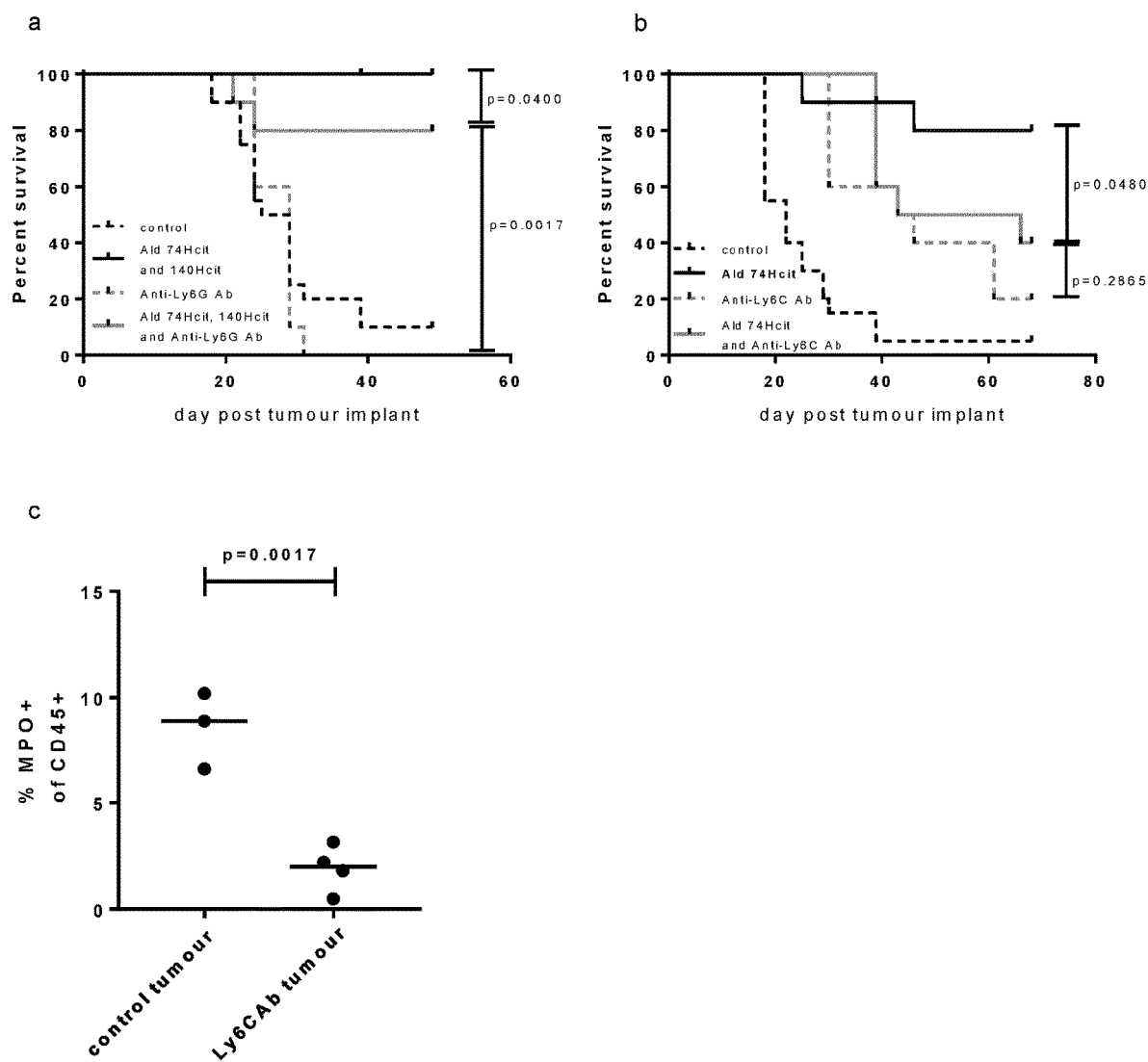

FIG. 23: The role of cell populations in the anti-tumour effect seen in response to Hcit ALDOA peptides Anti-Ly6G (a) or Anti-Ly6C (b) antibodies were injected in to mice during anti-tumour studies to determine the role of these cell populations in the anti-tumour effect seen in response to Hcit ALDOA peptides. P values shown compare survival in the groups given the combination of peptide and antibody to groups given peptide alone or antibody alone. The percentage of MPO+ cells in TILs from control mice or mice given anti-Ly6C Ab and ALDOA immunisations are shown (c).

FIG. 24: In vitro carbamylation: In vitro grown bone marrow derived MDSCs (BM-MDSCs) produce MPO and leading to carbamylation of B16 cells BM-MDSCs were derived from mice. Staining was performed to identify MPO+ cells in both the M-MDSCs and G-MDSC populations both unstimulated and after LPS stimulation (a). Co-culture of B16 cells with MDSCs was performed in the presence of potassium thiocyanate and $H_2O_2$. The level of Carbamyation was then assessed by staining with an anti-carbamylysine antibody (b).

Figure 25:
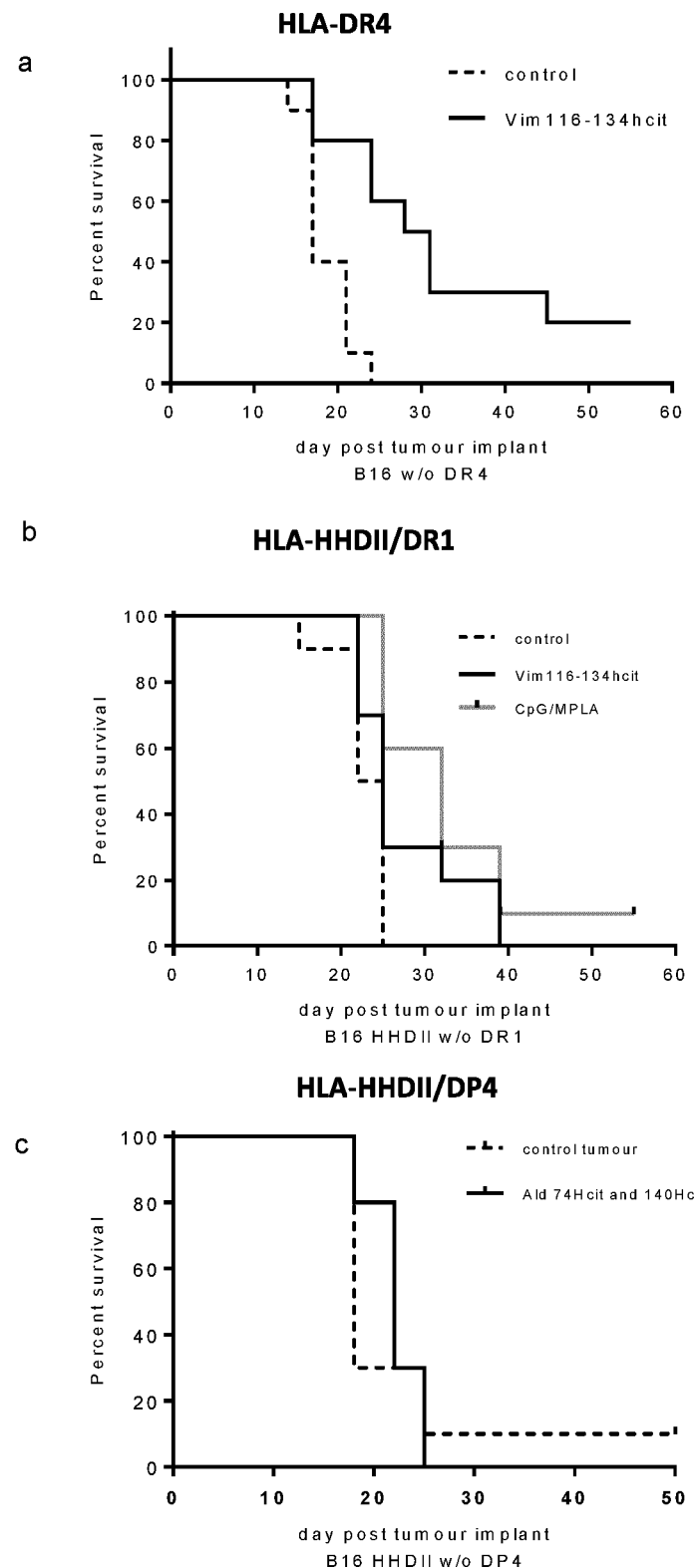

FIG. 25: Tumour survival is dependent on expression of MHCII

In vivo tumour survival studies were also carried out using B16F1 cell lines which lack appropriate MHCII expression. Transgenic B16F1 cells were implanted s.c. on the right flank on day 1. On day 4, 11 and 18 mice were immunised with peptide with CpG/MPLA. For vimentin 116-135 Hcit, anti-tumour studies were performed using B16F1 lacking DR4 (a) and with B16F1 HHDII lacking DR1 (b) in the appropriate mouse strains. For ALDOA 74-93Hcit and ALDOA 140-157 Hcit survival was determined after implant with B16F1 HHDII lacking DP4 expression (c). Statistical analysis was performed comparing survival in immunised mice to survival in control mice, significant p values are shown.

Figure 26:
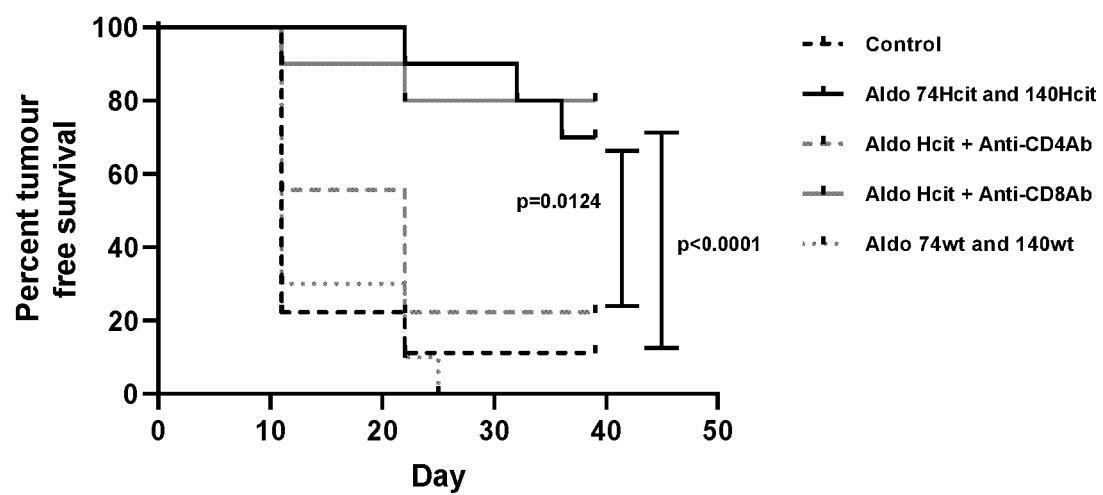

FIG. 26: Tumour survival is dependent on CD4 responses

In vivo tumour survival studies were also carried out using B16F1 HHDII/iDP4 cell lines in the presence of CD4 or CD8 depletion antibodies. Transgenic B16F1 HHDII/DP4 cells were implanted s.c. on the right flank on day 1. On day 4, 8 and 11 mice were immunised with peptide with CpG/MPLA and given i.p. injections of depletion antibodies. Statistical analysis was performed comparing survival in immunised mice to survival in immunised mice also given antibodies, significant p values are shown.

FIG. 27: Tree map is another illustrative approach to show diversity to ALDOA 74-93hcit. Tree map of the CD4 sorted CFSE high (A) and the CFSE low (B) TRA chain in response to ALDOA 74-93hcit. Tree map of the CD4 sorted CFSE high (C) and the CFSE low (D) TRB chain in response to ALDOA 74-93hcit. Each rounded rectangle represents a unique entry: V-J-uCDR3, where the size of the spot denotes the relative frequency.

FIG. 28: TCR9 a) Sequence 3 hTRBV10-3-CDR3 (AISERRDQETQY (SEQ ID NO: 87)), b) Sequence 4 hTRAV26-2-CDR3 (ILRDVYDYKLS (SEQ ID NO: 90)). CDRs are shown in bold.

FIG. 29: TCR10 a) Sequence 15 hTRBV20-1-CDR3 (SAPIHTDTQY (SEQ ID NO: 93)) b) Sequence 16 hTRAV36/DV7-CDR3 (AVHDAGNMLT (SEQ ID NO: 96)). CDRs are shown in bold.

FIG. 30: TCR11 a) Sequence 17 hTRBV12-4-CDR3 (ASRGGLASNEQF (SEQ ID NO: 99)), b) Sequence 18 hTRAV8-6-CDR3 (AVSEGGGSYIPT (SEQ ID NO: 102)). CDRs are shown in bold.

FIG. 31: TCR12 a) Sequence 19 hTRBV19-CDR3 (AS-SLGTFYEQY (SEQ ID NO: 105)) b) Sequence 20 hTRAV13-1-CDR3 (AASGNTNAGKST (SEQ ID NO: 108)). CDRs are shown in bold.

FIG. 32: TCR13 a) Sequence 21 hTRBV5-1-CDR3 (AS-SLGVMVVSTDTQY (SEQ ID NO: 111)) b) Sequence 22 hTRAV26-2-CDR3 (ILRDRVSNFGNEKLT (SEQ ID NO: 112)). CDRs are shown in bold.

FIG. 33: TCR14 a) Sequence 23 hTRBV11-2-CDR3 (ASSPTQGASYEQY (SEQ ID NO: 115)), b) Sequence 24 hTRAV3-CDR3 (AVRDAGYSTLT (SEQ ID NO: 118)). CDRs are shown in bold.

FIG. 34: TCR16 Sequence 3 hTRBV10-3-CDR3 (AISERRDQETQY (SEQ ID NO: 87), FIG. 17a) a) Sequence 25 hTRAV13-1-CDR3 (AASIDRDDKII (SEQ ID NO: 119)). CDRs are shown in bold.

FIG. 35: TCR17 a) Sequence 26 hTRBV28-CDR3 (AT-TQGSYNEQF (SEQ ID NO: 122)) b) Sequence 27 hTRAV20-CDR3 (AVQAGSYIPT (SEQ ID NO: 125)). CDRs are shown in bold.

FIG. 36: Tree map is another illustrative approach to show diversity to ALDOA 140-157hcit. Tree map of the CD4 sorted CFSE high (A) and the CFSE low (B) TRA chain in response to ALDOA 74-93hcit. Tree map of the CD4 sorted CFSE high (C) and the CFSE low (D) TRB chain in response to ALDOA 140-157hcit. Each rounded rectangle represents a unique entry: V-J-uCDR3, where the size of the spot denotes the relative frequency.

FIG. 37: TCR19 a) Sequence 28 hTRBV20-1-CDR3 (SARTSGTNTQY (SEQ ID NO: 126)), b) Sequence 29 hTRAV8-4-CDR3 (AVSGRNDYKLS (SEQ ID NO: 129). CDRs are shown in bold.

FIG. 38: TCR20 a) Sequence 30 hTRBV6-3-CDR3 (AS-SRSWTASGYT (SEQ ID NO: 132)), b) Sequence 31 hTRAV26-2-CDR3 (ILRDGSGNEKLT (SEQ ID NO: 133))). CDRs are shown in bold.

FIG. 39: TCR21 a) Sequence 32 hTRBV12-3-CDR3 (ASSVAQLAGKGEQF (SEQ ID NO: 135)), Sequence 25 hTRAV13-1-CDR3 (AASIDRDDKII (SEQ ID NO: 119) (FIG. 23a). CDRs are shown in bold.

FIG. 40: TCR22 a) Sequence 33 hTRBV2-CDR3 (AS-RRVMGYGYT (SEQ ID NO: 138)), b) Sequence 34 hTRAV21-CDR3 (ALNSGGSNYKLT (SEQ ID NO: 141)). CDRs are shown in bold.

FIG. 41: TCR23 a) Sequence 35 hTRBV20-1-CDR3 (SAGRAGTSGTYEQY (SEQ ID NO: 142)), b) Sequence 36 hTRAV26-2-CDR3 (ILRSNFGNEKLT (SEQ ID NO: 143)). CDRs are shown in bold.

FIG. 42: TCR24 a) Sequence 37 hTRBV19-CDR3 (AS-SGGQFNQPQH (SEQ ID NO: 144)), b) Sequence 38 hTRAV6-CDR3 (ALGQTGANNLF (SEQ ID NO: 147)). CDRs are shown in bold.

FIG. 43: TCR25 a) Sequence 39 hTRBV18-CDR3 (AS-SPEALANTGELF (SEQ ID NO: 150)), b) Sequence 40 hTRAV26-1-CDR3 (IVRVGYNNNDMR (SEQ ID NO: 153)). CDRs are shown in bold.

FIG. 44: TCR26 a) Sequence 41 hTRBV24-1-CDR3 (ATSDPSGPPYEQY (SEQ ID NO: 156)), b) Sequence 42 hTRAV26-2-CDR3 (ILRAQGGSEKLV (SEQ ID NO: 157)). CDRs are shown in bold.

FIG. 45: TCR27 a) Sequence 43 hTRBV2-CDR3 (AS-RAGTGIGGYT (SEQ ID NO: 158))), b) Sequence 44 hTRAV21-CDR3 (AVYSGGSNYKLT (SEQ ID NO: 159)). CDRs are shown in bold.

FIG. 46: Tree map is another illustrative approach to show diversity vimentin 116-135hcit. Tree map of the CD4 sorted CFSE high (A) and the CFSE low (B) TRA chain in response to vimentin 116-135hcit. Tree map of the CD4 sorted CFSE high (C) and the CFSE low (D) TRB chain in response to vimentin 116-135hcit. Each rounded rectangle represents a unique entry: V-J-uCDR3, where the size of the spot denotes the relative frequency.

FIG. 47: TCR1 a) Sequence 1 hTRBV28-CDR3 (AS-SLLGSSPLH (SEQ ID NO: 160)), b) Sequence 2 hTRAV38-2/DV8-CDR3 (AYRSYNQGGKLI (SEQ ID NO: 163)). CDRs are shown in bold.

FIG. 48: TCR4 a) Sequence 5 hTRBV3-1-CDR3 (AS-SQEPSTHNEQF (SEQ ID NO: 166)), b) Sequence 6 hTRAV26-2-CDR3 (ILKNYGGSQGNLI (SEQ ID NO: 167)). CDRs are shown in bold.

FIG. 49: TCR5 a) Sequence 7 hTRBV6-6-CDR3 (AS-SPGQPYGYT (SEQ ID NO: 170)), b) Sequence 8 hTRAV16-CDR3 (ALSGPSYGQNFV (SEQ ID NO: 173)). CDRs are shown in bold.

FIG. 50: TCR6 a) Sequence 9 hTRBV6-1-CDR3 (ASE-GLASYNEQF (SEQ ID NO: 176)), b) Sequence 10 hTRAV9-2-CDR3 (ALTGGGYQKVT (SEQ ID NO: 179)). CDRs are shown in bold.

FIG. 51: TCR7 a) Sequence 11 hTRBV27-CDR3 (ASSFREGEKLF (SEQ ID NO: 181)), b) Sequence 12 hTRAV17-CDR3 (ATAMNTGFQKLV (SEQ ID NO: 184)). CDRs are shown in bold.

FIG. 52: TCR8 a) Sequence 13 hTRBV4-2-CDR3 (ASS-REGLAGLNEQF (SEQ ID NO: 187)), b) Sequence 14 hTRAV29/DV5-CDR3 (AASGWGDGGATNKLI (SEQ ID NO: 190)). CDRs are shown in bold.

FIG. 53: HLA-DP4 binding a) binding of HepB 181-193 but not negative control peptides to HLA-DP4, b) competition of biotinylated HepB peptide binding with unlabelled HepB peptide, c) competition of homocitrulline containing and wild type aldolase peptides with biotinylated HepB peptide for binding to HLA-DP4, d) competition of homocitrulline containing cytokeratin 8 peptides with biotinylated HepB peptide for binding to HLA-DP4, e) competition of homocitrulline containing and wild type vimentin peptide with biotinylated HepB peptide for binding to HLA-DP4.

Methods
Cell Lines and Culture

The murine melanoma B16F1 cell line (ATCC-CRL-6323) was obtained from the American Tissue Culture Collection (ATCC). B16F1 was cultured in RPMI medium 1640 (GIBCO/BRL) supplemented with 10% fetal calf serum (FCS), L-glutamine (2 mM) and sodium bicarbonate buffered to pH7. The cell line utilised were mycoplasma free, authenticated by suppliers (STR profiling), and are used within ten passages.

Plasmids and Transfections

Cell lines were transfected using the Lipofectamine Transfection Reagent (Invitrogen) utilising the protocol previously described (Brentville et al. 2016). B16F1 cells were knocked out for murine MHC-I and/or MHC-II using ZFN technology (Sigma) and transfected with constitutive HLA-DR4, HLA-DR1 or HLA-DP4 using the the pVitro 2 chimeric plasmid. Cells were also transfected with the HHDII plasmid comprising of a human HLA-A2 leader sequence, the human β2-microglobulin (β2M) molecule covalently linked via a glycine serine linker to the α 1 and 2 domains of human HLA-0201 MHC class 1 molecule and the α3, transmembrane and cytoplasmic domains of the murine H-2 Db class 1 molecule, where relevant as previously described (Xue et al. 2016). B16F1 cells were also transfected with the IFNγ-inducible HLA-DR4 or HLA-DP4 using the pDC GAS chimeric HLA-DR401 or HLA-DP4 plasmids where chimeric HLA-DR401 or HLA-DP4 are under expression of the IFNγ-inducible promoter. Plasmid details and transfection protocol have previously been described in full (Brentville et al. 2016; Brentville et al. 2019). Transfected cells were grown in the presence of zeocin (300 µg/ml), hygromycin B (300 µg/ml) or G418 (500 µg/ml).

In Vitro Carbamylation and Detection

Carbamylation of proteins was performed following the protocol previously described (Shi et al. 2011). Briefly, foetal calf serum, recombinant human ALDOA (Sigma) or vimentin (Abcam) proteins or B16F1 cell lysate prepared by 4 cycles of freeze/thaw were in vitro carbamylated by incubating in the presences of 1M KCNO at 37° C. for 10 hrs. For B16F1 cell lines, cells were allowed to adhere to flasks and media was then supplemented with KCNO to a final concentration of 1M overnight. After treatment cells were removed from flask using a cell scraper and lysed by freeze/thaw. All samples were then extensively dialysed in $dH_2O$. OXIselect carbamylation ELISA (Cell Biolabs) was used to detect carbamylation following the manufacturer's instructions.

Mass Spectrometry

Samples were prepared by trypsin digest at a ratio of 1:50 trypsin to protein overnight at 37° C. Samples were then dried under vacuum and resuspended in 0.1% formic acid/5% acetonitrile in LCMS grade water before MS analysis. For MS Analysis, samples were injected via autosampler (Eksigent Ekspert nanoLC 425 LC system utilising a 1-10 µl/min pump module running at 5 µl/min) with a 2 min wash trap/elute configuration onto a YMC Triart C18 column (300 um i.d., 3 µm particle size, 15 cm) in a column oven at 35° C. Samples were gradient eluted over an 87 min runtime into a SCIEX 6600 Triple Tof mass spectrometer via a Duospray (TurboV) source with a 50 µm electrode. The 6600 was set up in IDA mode (Independent Data Acquisition/Data Dependent Acquisition) for 30 ions per cycle fragmentation. Total cycle time 1.8s, TOFMS scan 250 ms accumulation; 50 ms for each product ion scan.

Data was analysed using PEAKS Studio 8.0 (Bioinformatic Solutions Inc. Waterloo, Canada) searching the SwissProt human (Uniprot manually annotated/curated) database, 25 ppm parent mass error tolerance, 0.1 Da fragment mass error tolerance searching for modifications for citrullination (R), deamidation (NQR), oxidation (M). Sites were identified as a confident modification site with a minimum ion intensity of 5%.

Immunogens

Peptides of >90% purity were synthesized by Genscript (New Jersey, USA) and stored lyophilised in 0.2 mg to 0.4 mg aliquots at −80° C. On the day of use they were reconstituted to the appropriate concentration with phosphate buffered saline (PBS).

Immunisation Protocol

C57BL/6 mice (Charles River, UK), HLA-DR4 mice (Model #4149, Taconic, USA), HLA-A2/DR1 (HHDII/DR1, Pasteur Institute), HLA-A2.1+/+HLA-DP4+/+ hCD4+/+ (HLA-HHDII/DP4) transgenic mice (EM: 02221, European Mouse Mutant Archive) described in patent WO2013/017545 A1 (EMMA repository, France) were used, aged between 8 and 12 weeks. Peptides were dissolved in PBS to 1 mg/ml and then emulsified (a series of dilutions) with CpG ODN 1826 and MPLA 6 µg/mouse of each (Invivogen, UK). Peptides (25 µg/mouse) were injected subcutaneously at the base of the tail. Mice were immunised at days 1, 7 and 14 for peptide immunisation. Spleens were removed for analysis at day 21 unless stated otherwise.

For tumour challenge experiments, mice were challenged with B16F1 cells s.c. on the right flank 3 days before primary immunisation (unless stated otherwise) and subsequently immunised as above. Tumour implants were carried out at dose of $2.5 \times 10^4$ cells/mouse for B16F1, $2.5 \times 10^4$ cells/mouse for B16F1 DR4, $4 \times 10^5$ cells/mouse for B16F1 HHDII/DP4, $5 \times 10^5$ cells/mouse for B16 HHDII/DR1, $1 \times 10^5$ cells/mouse for B16F1 HHDII/inducibleDP4, $5 \times 10^4$ cells/mouse for B16F1 inducible DR4. For studies involving depletion antibodies, 250 µg anti-mouse Ly6C antibody (clone Monts, BioXcell) was administered i.p. on days 8, 10, 12, 15, 17 and 19. 400 µg anti-mouse Ly6G antibody (clone 1A8, Biolegend) was administered i.p. on day 8 followed by 250 µg on days 11, 15 and 18. Anti-human CD4 antibody (clone OKT4, BioXcell) or anti-mouse CD8 antibody (clone 2.43, BioXcell) were administered at 500 µg dose on day 4 followed by 300 µg dose on days 8 and 11. Tumour growth was monitored twice weekly and mice were humanely euthanised once tumour reached ≥15 mm in diameter.

Analysis of Immune Response-Ex Vivo ELISpot Assay

ELISpot assays were performed using murine IFNγ, IL-17 and IL-10 capture and detection reagents according to the manufacturer's instructions (Mabtech, Sweden). In brief, anti-IFNγ, IL-17 and IL-10 specific antibodies were coated onto wells of 96-well Immobilin-P plate. Synthetic peptides (at various concentrations) and $5 \times 10^5$ per well splenocytes were added to wells of the plate in quadruplicate Tumour target cells were added where relevant at $5 \times 10^4$/well in triplicate and plates incubated for 40 hrs at 37° C. After incubation, captured IFNγ, IL-10 and IL-17 were detected by biotinylated anti-IFNγ, IL-10 and IL-17 antibodies and developed with a streptavidin alkaline phosphatase and chromogenic substrate. Lipopolysaccharide (LPS; 5 µg/ml) was used as a positive control. For MHC blocking studies, anti-CD4 blocking antibody (GK1.5) or anti-CD4 blocking antibody (RPA-T4) for HHDII/DP4 mice which express human CD4 and anti-CD8 blocking antibody (2.43) from Bioxcell were used at 20 µg/ml. Spots were analysed and counted using an automated plate reader (Cellular Technologies Ltd).

Isolation and Analysis of Animal Tissue

Spleens were disaggregated and treated with red cell lysis buffer for 2 mins. Tumours were harvested and mechanically disaggregated. Cells were then stained with 1:50 dilution of anti-CD45 (efluor 450, clone 30-F11), anti-CD11b (PE-Cy7, clone M1/70), anti-Ly6C (APC, Clone HK1.4) and anti-Ly6G (FITC, Clone RB6-8C5) (Thermofisher). Cells were washed, fixed and permeabilized using intracellular fixation/permeablization buffers (ThermoFisher) according to the manufactures instructions. Intracellular staining for cytokines was performed using a 1:10 dilution of anti-MPO (PE, clone HM105, Hycult Biotech). Stained samples were analysed immediately on a MACSQuant 10 flow cytometer equipped with MACSQuant software version 2.8.168.16380.

In Vitro Production of MDSCs and Co-Culture with B16

Bone marrow derived MDSCs were produced by isolating bone marrow from mice and then culturing in the presence of GM-CSF (1 ng/ml) and IL-18 (50 ng/ml) for 6 days. For co-culture experiments B16 cells were seeded in a monolayer and then incubated with MDSCs at a ratio of 1:10. Potassium thiocyanate (200 µM) and $H_2O_2$ (10 µM) were added when stated. Cells were then incubated overnight before staining. CarbLy staining was perfromed using Rabbit Anti-Carbamylation (Homocitrulline) Polyclonal Antibody (#CAY22428-1ea #) at 1/50 for 1 hours followed by donkey anti-rabbit-A647 conjugated secondary (#ab150063) used 1/1000 for 1 hour.

Peripheral Blood Mononuclear Cell (PBMC) Isolation

Demographics of healthy donors and patients are given in Table 5a and b. Peripheral blood samples were drawn into lithium heparin tubes (Becton Dickinson) and processed immediately following venepuncture. PBMCs were isolated by density gradient centrifugation using Ficoll-Hypaque. Proliferation and cultured ELISpot assay of PBMCs were performed immediately after isolation. For CD25 depletion PBMCs were processed as above and enriched using anti-CD25 microbeads and MACS Cell Separation Columns (Miltenyi).

Proliferation Assay-Carboxyfluorescein Succinimidyl Ester (CFSE)

Briefly, a 50 µM stock solution in warm PBS was prepared from a master solution of 5 mM in dimethyl sulfoxide (DMSO). CFSE was rapidly added to PBMCs ($5 \times 10^6$ cells/ml loading buffer (PBS with 5% v/v heat inactivated FCS)) to achieve a final concentration of 5 µM. PBMCs were incubated at room temperature in the dark for 5 mins after which non-cellular incorporated CFSE was removed by washing twice with excess (×10 v/v volumes) of loading buffer (300g ×10 mins). Cells were made up in complete media to $1.5 \times 10^6$/mL and plated and stimulated with vehicle (negative control), PHA (positive control, final concentration 10 µg/ml) or peptide (10 µg/ml) as described above.

On day 10, 500 µl of cells were removed from culture, washed in PBS and stained with 1:50 dilution of anti-CD4 (PE-Cy5, clone RPA-T4, ThermoFisher), anti-CD8 efluor 450, clone RPA-T8, ThermoFisher) and anti-CD134 (PE-Cy7, Clone REA621, Miltenyi). Cells were washed, fixed and permeabilised using intracellular fixation/permeablisation buffers (ThermoFisher) according to the manufactures instructions. Intracellular staining for cytokines was performed using a 1:50 dilution of anti-IFNγ (clone 4S.B3, ThermoFisher) or anti-Granzyme B (PE, Clone GB11, Thermofisher). Stained samples were analysed immediately on a MACSQuant 10 flow cytometer equipped with MACSQuant software version 2.8.168.16380.

FACS Cell Sorting

On day 10, the contents of the culture wells were mixed gently, pooled (according to peptide stimulation) and washed in PBS (300g ×10 mins). Pellets were gently resuspended in 500 µL of PBS containing 10 µl of anti CD4 eFluo450 (clone RPA-T4, ThermoFisher, cat no 48-0049-42) and 10 µL of anti-CD8 APC (clone RPA-T8, ThermoFisher, cat 17-0088-41). Cells were stained at 4° C. for 30 mins before being washed (5 min ×300g) in 1.0 ml of PBS and resuspended in 300 µl of FACS sorting buffer (PBS supplemented with 1 mM EDTA, 25 mM HEPES and 1% v/v HI FCS). 10 µl of sample was removed from each stained sample and 90 µl of FACS sorting buffer added. 10,000 events were collected on a MACSQuant Analyser 10 flow cytometer to determine proliferation. The remaining cells were used for bulk FACS sorting.

Cells were sorted using sterile conditions in a MoFlo XDP High Speed Cell Sorter machine. All samples were sorted into 1.0 ml of RNA protect (5 parts Protect, Qiagen: 1 part FACS sorting buffer, Sigma) separating the CD4+ve/CFSE-high and CD4+ve/CFSE$^{low}$ populations. Sorted cells (bulk) were stored at $-80°$ C.

Determination of the α and β chain pairing of TCRs recognising peptides containing homocitrulline. Sorted cells (bulk) from CD4+ve/CFSEhigh and CD4+ve/CFSE$^{low}$ populations in RNA protect were shipped to iRepertoire Inc (Huntsville, AL, USA) for NGS sequencing of the TCRA and TCRB chain to confirm expansion of TCR's in the CD4+ve/CFSE$^{low}$ cells, proliferating to the peptide in contrast to the non proliferating CD4+ve/CFSEhigh population. In brief RNA was purified from sorted cells, RT-PCR was performed, cDNA was then subjected to Amplicon rescued multiplex PCR (ARM-PCR) using human TCR α and β 250 PER primers (iRepertoire Inc., Huntsville, AL, USA). Information about the primers can be found in the United States Patent and Trademark Office (U.S. Pat. Nos. 7,999,092 and 9,012,148β2). After assessment of PCR/DNA samples, 10 sample libraries were pooled and sequenced using the Illumina MiSeq platform (Illumina, San Diego, CA, USA). The raw data was analysed using IRweb software (iRepertoire). V, D, and J gene usage and and CDR3 sequences were identified and assigned and tree maps generated using iRweb tools. Tree maps show each unique CDR3 as a coloured rectangle, the size of each rectangle corresponds to each CDR3 abundance within the repertoire and the positioning is determined by the V region usage.

To elucidate the cognate pairing and sequencing of TCRa and TCRB chains IRepertoire used their iPair™ technology, the CD4$^{+ve}$/CFSE$^{low}$ populations of cells (bulk sorted, that were simultaneously bulk sequenced) were seeded at 1 cell/well into a iCapture 96 well plate. RT-PCR is performed and the TCRα and β chains where amplified from the single cells using Amplicon rescued multiplex PCR (arm-PCR). Data was analysed utilising the iPair™ Software program for frequency of specific chain pairing and the sequences ranked on comparison to bulk data.

DP4 Preparation for Binding Assay

2×T175 gave $2.5 \times 10^7$ B16 HHDII/DP4 (B16F1 β2M H2Ab1 dKO A35 HHDII/DP4 H7/2E9/F9 p14) cells. This was enough for 5 preps using the following protocol with Mem-PER™ Plus Membrane Protein Extraction Kit (thermo-scientific cat #89842).

$5 \times 10^6$ cells were resuspended in the growth media by scraping the cells off the surface of the plate with a cell scraper and then centrifuged at 300 g for 5 mins. The cell pellet was washed with 3 ml of Cell Wash Solution and centrifuged at 300 g for 5 mins. The supernatant was removed and discarded. The cells were resuspended in 1.5 ml of Cell Wash Solution and transfer to a 2 ml centrifuge tube and centrifuged at 300 g for 5 mins. The supernatant was discarded. 0.75 ml of permeabilization buffer was added to the cell pellet and vortexed briefly to obtain a homogeneous cell suspension and incubated for 10 mins at 4° C. with constant mixing. The permeabilized cells were centrifuge for 15 mins at 16,000g before carefully removing the supernatant containing cytosolic proteins and transfering to a new tube. 0.5 ml of solubilization buffer was added to the pellet and resuspend prior to incubating at 4° C. for 30 minutes with constant mixing prior to centrifugation at 16,000g for 15 mins at 4° C. The supernatant containing solubilized membrane and membrane-associated proteins was transferred to a new tube. Aliquots were frozen at −80° C. for future use. 12.5 µl Halt™ Protease and Phosphatase Inhibitor Cocktail, EDTA-free (100X) thermo-scientific (Catalog number 78445) was added prior to freezing.

DP4 Binding ELISA.

High binding plates were coated with streptavidin (Sigma S4762 at 1 mg/ml) 1/500 in PBS and incubated overnight at 4° C. The plates were blocked with 1% BSA in PBS for 4 hrs at room temp and washed 3× PBS/0.5% Tween. 450 µl of cell prep lysate was incubated with 50 µg biotinylated peptide and incubated for 4 hrs at 37° C.: Lysate/peptide mix was added to the plates at 100 µl/well and incubated for 4 hrs at room temperature. Plates were washed 3× with PBS/0.5% Tween. 100 µl per well of Leinco anti-Human HLA-DP4 clone B7/21 #H260 1 mg/ml at 1/500 dilution in 1% BSA/PBS was added to the lysate and incubated for 1 hr at room temperature before washing 3× PBS/0.5% Tween. Goat anti-mouse lgG3-HRP at 0.5 mg/ml 1/500 100 µl per well (Invitrogen #M32607) diluted in 1% BSA/PBS) was added for 1 hr. The plates were washed and 150 µl of TMB substrate was added to each well. The reaction was stopped with 50 µl of 2N $H_2SO_4$ and the plates read at 450 nm.

DP4 competition assay.

High binding plates were coated with streptavidin (Sigma S4762 at 1 mg/ml) 1/500 in PBS and incubated overnight at 4° C. The plates were blocked with 1% BSA in PBS for 4 hrs at room temp and washed 3×PBS/0.5% Tweenx. 450 µl of cell prep lysate (B16F1 B16 HHDII/DP4 $H_{7/2}$E9/F9) was mixed with 50 µg test peptide (see below) or 10 µg of unlabelled Hep B peptide for 30 mins. 10 µg biotinylated Hep B peptide was added & incubated for 4 hrs at 37° C.:

| | | |
|---|---|---|
| Hep B | 181-192 | GFFLLTRILTIPQ (SEQ ID NO: 191) |
| Fibrinogen | 78-91 cit (Hu) | NQDFTN-cit-INKLKNS (SEQ ID NO: 1628) |
| Collagen II | 1236-1249 cit (Hu) | LQYM-cit-ADQAAGGLR. (SEQ ID NO: 1629) |
| Aldolase A | 74-93 | IGGVILFHETLYQ-hcit-ADDGRP (SEQ ID NO: 15) |
| Aldolase A | 74-93 WT | IGGVILFHETLYQKADDGRP (SEQ ID NO: 15) |
| Aldolase A | 140-157 | hcit-DGADFA-hcit-WRCVL-hcit-IGEH (SEQ ID NO: 16) |
| Aldolase A | 140-157 WT | KDGADFAKWRCVLKIGEH (SEQ ID NO: 16) |
| Aldolase A | 217-235 | LSDHHVYLEGTLL-hcit-PNMVT (SEQ ID NO: 194) |
| Aldolase A | 238-256 | HACTQ-hcit-FSH(N)EEIAMATVTA (SEQ ID NO: 195) |
| Aldolase A | 289-307 | hcit-CPLL-hcit-PWALTFSYGRALQ (SEQ ID NO: 19) |
| Cytokeratin 8 | 101-120 | KFASFID-Hcit-VRFLEQQN-Hcit-MLE (SEQ ID NO: 25) |
| Cytokeratin 8 | 112-131 | LEQQN-hcit-MLET-hcit-WSLLQQQ-hcit-T (SEQ ID NO: 26) |
| Cytokeratin 8 | 182-202 | EIN-hcit-RTEMENEFVLI-hcit-hcit-DVDE (SEQ ID NO: 28) |
| Cytokeratin 8 | 371-388 | LREYQELMNV-hcit-LALDIEI (SEQ ID NO: 29) |
| Cytokeratin 8 | 381-399 | hcit-LALDIEIATYR-hcit-LLEGEE (SEQ ID NO: 30) |
| Vimentin | 116-135 | NYID-hcit-VRFLEQQN-hcit-ILLAEL (SEQ ID NO: 3) |
| Vimentin | 116-135 WT | NYID-hcit-VRFLEQQN-hcit-ILLAEL (SEQ ID NO: 3) |

Lysate/peptide mix was added to the plates at 100 μl/well and incubated for 4 hrs at room temperature. Plates were washed 3× with PBS/0.5% Tween. 100 μl per well of Leinco anti-Human HLA-DP4 clone B7/21 #$H_{260\,1}$ mg/ml at 1/500 dilution in 1% BSA/PBS was added and incubated for 1 hr at room temperature prior to washing 3× PBS/0.5% Tween. Goat anti-mouse lgG3-HRP at 0.5 mg/ml 1/500 100 μl per well (Invitrogen #M32607) diluted in 1% BSA/PBS) was added for 1 hr at room temperature prior to washing and adding 150 μl of TMB substrate to each well. The reaction was stopped with 50 μl of 2N $H_2SO_4$ and plates read plate at 450 nm.

Statistical Analysis

Statistical analysis was performed using GraphPad Prism software version 7. Comparative analysis of the ELISpot results was performed by applying paired or unpaired ANOVA or Student t test as appropriate with values of p calculated accordingly. Comparison of tumour survival was assessed by log-rank test. $p<0.05$ values were considered statistically significant and $p<0.01$ values were considered highly significant.

Example 1. CD4 Responses to Homocitrullinated Vimentin 116-135

In silico bioinformatic analysis of vimentin (Table 2) was performed to identify peptide sequences with high binding affinity to human MHC class II using the online IEDB prediction program (iedb.org/). The top binding affinity peptides whose core binding region contained a lysine and demonstrated homology between human and mouse were selected. The lysine residues were replaced with homocitrulline (Hcit). The selected peptides are summarised in Table 1, PepFold (spiral) analysis was done retrospectively.

Screening of Vimentin Peptide Responses

Screening was performed to identify potential homocitrullinated vimentin epitopes in mice. Mice were immunised with pools of homocitrullinated peptides. To reduce the effect of possible cross reactivity, the peptides within the pool were chosen so that they did not contain any overlapping amino acid sequences. Each pool was administered as three immunisations containing 20 μg of each peptide and CpG/MPLA as an adjuvant on day 1, 8 and 15. On day 21 the mice were culled and the immune responses to each peptide within the immunising pool were assessed by ex vivo ELISpot. Given that different mouse strains have different MHC repertoires a number of strains were used for screening. Peptide responses were assessed in transgenic strains expressing human DR4 or HHDII/DR1 in a C57BL/6 background (see methods).

Significant IFNγ responses were detected to peptide vimentin 116-135 Hcit. In both HLA-DR4 (FIG. 4a) and HHDII/DR1 (FIG. 4c) mice, the pool containing the Hcit vimentin 116-135 peptide induced a significant response to vimentin 116-135 Hcit. No other peptides showed significant IFNγ responses in HLA-DR4 or HHDII/DR1 mice. Our predictions therefore only identified 1/5 peptides which could induce a T cell response. In addition, responses to vimentin 116-135 Hcit were tested in HHDII/DP4 and C57BI/6 mice but no IFNγ responses were observed (FIG. 5a). This result suggested the homocitrullinated vimentin peptide 116-135 justified further investigation. In addition, immunisation of HHDII/DR1 or HLA-DR4 mice with the unmodified peptide (vimentin 116 wt) failed to induce any responses (FIG. 5b). Thus a key characteristic of immunogenic peptides is they express homocitrulline.

TABLE 2

Vimentin peptides.

| Protein | coor- din- ates | se- quence | DP4 predic- tion score | DP4 predic- ted cores | DR4 predic- tion score | DR4 predic- ted cores | DR1 predic- tion scores | DR1 predic- ted cores | Spi- ral | T cell re- sponse |
|---|---|---|---|---|---|---|---|---|---|---|
| Vimen- tin | 116-135 | NYID- hcit- VRFLEQQN- hcit- ILLAEL (SEQ ID NO: 3) | 2.12- 17.18 2.12 30.02 30.02 | IDKVRFLEQ (SEQ ID NO: 197) YIDKVRFLE (SEQ ID NO: 198) KVRFLEQQN (SEQ ID NO: 199) RFLEQQNKI (SEQ ID NO: 200) | 5.06- 38.50 5.06 38.50 | VRFLEQQNK (SEQ ID NO: 201) FLEQQNKIL (SEQ ID NO: 202) YIDKVRFLE (SEQ ID NO: 198) | 11.76- 14.32 14.32- 58.24 58.24 | FLEQQNKIL (SEQ ID NO: 202) VRFLEQQNK (SEQ ID NO: 201) RFLEQQNKI (SEQ ID NO: 200) | 〰〰〰 | yes |
| Vimen- tin | 215-235 | LARLDLER- hcit- VESLQE EIAFL- hcit (SEQ ID NO: 4) | 21.67- 49.11 44.08- 60.82 57.44- 60.82 | KVESLQEEI (SEQ ID NO: 203) LERKVESLQ (SEQ ID NO: 204) ARLDLERKV (SEQ ID NO: 205) | 24.51- 30.76 26.21 26.21- 30.76 | LERKVESLQ (SEQ ID NO: 204) ARLDLERKV (SEQ ID NO: 205) LDLERKVES (SEQ ID NO: 206) | 76 79.7- 81.37 79.70- 81.37 | ERKVESLQE (SEQ ID NO: 207) ARLDLERKV (SEQ ID NO: 205) DLERKVESL (SEQ ID NO: 208) | 〰〰〰 | no |

TABLE 2-continued

Vimentin peptides.

| Protein | coor-<br>din-<br>ates | se-<br>quence | DP4<br>predic-<br>tion<br>score | DP4<br>predic-<br>ted<br>cores | DR4<br>predic-<br>tion<br>score | DR4<br>predic-<br>ted<br>cores | DR1<br>predic-<br>tion<br>scores | DR1<br>predic-<br>ted<br>cores | Spi-<br>ral | T<br>cell<br>re-<br>sponse |
|---|---|---|---|---|---|---|---|---|---|---|
| Vimen-<br>tin | 255-275 | QIDVDVS-<br>hcit-<br>PDLTAALR<br>DVRQQ<br>(SEQ ID<br>NO: 5) | 82.48-<br>88.15 | VSKPDLTAA<br>(SEQ ID<br>NO: 209) | 17.21-<br>30.56<br>17.21<br>23.61<br>30.56 | SKPDLTAAL<br>(SEQ ID<br>NO: 210)<br>IDVDVSKPD<br>(SEQ ID<br>NO: 211)<br>VDVSKPDLT<br>(SEQ ID<br>NO: 212)<br>VSKPDLTAA<br>(SEQ ID<br>NO: 209) | 58.03<br>58.21-<br>62.81<br>58.03-<br>61.06 | SKPDLTAAL<br>(SEQ ID<br>NO: 210)<br>KPDLTAALR<br>(SEQ ID<br>NO: 213)<br>VDVSKPDLT<br>(SEQ ID<br>NO: 212) | | no |
| Vimen-<br>tin | 286-303 | EAEEWY-<br>hcit-<br>S-hcit-<br>FADLSEAAN<br>(SEQ ID<br>NO: 6) | 2.06-<br>2.22<br>2.06-<br>5.69<br>3.31-<br>5.69 | KSKFADLSE<br>(SEQ ID<br>NO: 214)<br>WYKSKFADL<br>(SEQ ID<br>NO: 215)<br>KFADLSEAA<br>(SEQ ID<br>NO: 216) | 4.76-<br>9.29<br>9.29-<br>11.26 | KFADLSEAA<br>(SEQ ID<br>NO: 216)<br>YKSKFADLS<br>(SEQ ID<br>NO: 217) | 18.99<br>18.99-<br>41.08 | KFADLSEAA<br>(SEQ ID<br>NO: 216)<br>YKSKFADLS<br>(SEQ ID<br>NO: 217) | | no |
| Vimen-<br>tin | 431-454 | LPLVDTHS-<br>hcit-<br>RTLLI-<br>hcit-<br>TVETRDGQV<br>(SEQ ID<br>NO: 196) | 35.09-<br>40.42<br>41.46-<br>60.30<br>41.46-<br>49.99<br>59.59-<br>60.30<br>22.22-<br>26.93 | THSKRTLLI<br>(SEQ ID<br>NO: 218)<br>TLLIKTVET<br>(SEQ ID<br>NO: 219)<br>HSKRTLLIK<br>(SEQ ID<br>NO: 220)<br>LLIKTVETR<br>(SEQ ID<br>NO: 223) | 9.5<br>9.5<br>10.96-<br>12.02<br>9.5-<br>12.02 | IKTVETRDG<br>(SEQ ID<br>NO: 221)<br>LIKTVETRD<br>(SEQ ID<br>NO: 222)<br>TLLIKTVET<br>(SEQ ID<br>NO: 219)<br>LLIKTVETR<br>(SEQ ID<br>NO: 223)<br>THSKRTLLI<br>(SEQ ID<br>NO: 218) | 24.07-<br>34.8<br>31.48-<br>41.38<br>24.07-<br>44.99 | KRTLLIKTV<br>(SEQ ID<br>NO: 224)<br>THSKRTLLI<br>(SEQ ID<br>NO: 218)<br>TLLIKTVET<br>(SEQ ID<br>NO: 219) | | no |

To further characterise the responses induced by the carbamylated peptides mice were immunised with Hcit peptides and splenocytes assessed for cross reactivity to the wt peptides and responses to the Hcit peptides in the presence of CD4 and CD8 blocking antibodies. Vimentin 116-135 Hcit IFNγ response in DR4 (FIG. 7a) and HHDII/DR1 (FIG. 7b) transgenic mice showed no cross reactivity to the unmodified wt peptide. Thus a key characteristic of immunogenic peptides is they express homocitrulline. The vimentin 116-135 Hcit response was significantly higher than the wt response in both DR4 (p<0.0001) and HHDII/DR1 (p<0.0001) mice. Cross reactivity was seen to a shorter Hcit peptide sequence spanning amino acid 120-134 in both DR4 (p=0.0001) and HHDII/DR1 (p=0.0005) mice. In both strains the vimentin 116-135 Hcit responses were significantly decreased with the addition of CD4 blocking antibody (p=0.0054 and p<0.0001, respectively) but not in the presence of the CD8 blocking antibody. These abrogated responses reveal that the responses are mediated by CD4 cells. Thus a key characteristic of the response is it is mediated by CD4 T cells. Splenocytes from mice showed no production of IL-10 and IL-17 in response to immunisation with vimentin 116-135 Hcit peptide (FIG. 5c & d).

Thus the minimal epitope in both DR4 and DR1 is vimentin 120-134 with homocitrulline at positions 120 and 129.

Next, we tested if vimentin can be carbamylated at our key residues. The recombinant protein was treated in vitro with potassium cyanate and carbamylation was assessed by ELISA. Carbamylation was significantly increased after treatment with potassium cyanate demonstrating that vimentin contains lysines that can be subject to homocitrullination (FIG. 9a). Next, carbamylated recombinant protein sample was analysed by mass spectrometry to determine the presence of homocitrulline molecules. Mass spectrometry demonstrates that vimentin (FIG. 9c) protein can be homocitrullinated at a number of sites. Together these results show that vimentin could undergo carbamylation at the correct sites.

Example 2. CD4 Responses to Homocitrullinated ALDOA

In silico bioinformatic analysis of ALDOA (Table 3) was performed to identify peptide sequences with high binding affinity to human MHC class II using the online IEDB prediction program (iedb.org/). The top binding affinity peptides whose core binding region contained a lysine and demonstrated homology between human and mouse were selected. The lysine residues were replaced with Hcit. The selected peptides are summarised in Table 3. PepFold (spiral) analysis was done retrospectively.

TABLE 3

ALDOA peptides utilised.

| Protein | coor-din-ates | se-quence | DP4 predic-tion score | DP4 predic-ted cores | DR4 predic-tion score | DR4 predic-ted cores | DR1 predic-tion scores | DR1 predic-ted cores | Spiral | T cell re-sponse |
|---|---|---|---|---|---|---|---|---|---|---|
| ALDOAA | 74-93 | IGGVIL FHETLY Q-hcit- ADDGRP (SEQ ID NO: 15) | 2.5- 8.04 3.09- 8.04 | FHETLYQKA (SEQ ID NO: 811) LFHETLYQK (SEQ ID NO: 225) | 30.22 30.22 | FHETLYQKA (SEQ ID NO: 811) LFHETLYQK (SEQ ID NO: 225) | 33.91- 60.75 46.61- 60.75 | FHETLYQKA (SEQ ID NO: 811) LFHETLYQK (SEQ ID NO: 225) |  | yes |
| ALDOAA | 140-157 | hcit-DGADFA-hcit-WRCVL-hcit-IGEH (SEQ ID NO: 16) | 22.10- 28.10 23 35- 28.10 22.10- 28.10 | FAKWRCVLK (SEQ ID NO: 228) AKWRCVLKI (SEQ ID NO: 226) DFAKWRCVL (SEQ ID NO: 227) | 49.80- 57.56 | FAKWRCVLK (SEQ ID NO: 228) | 59.86- 65.39 59.86- 65.39 | AKWRCVLKI (SEQ ID NO: 226) FAKWRCVLK (SEQ ID NO: 228) |  | yes |
| ALDOAA | 217-235 | LSDHH VYLEG TLL-hcit-PNMVT (SEQ ID NO: 194) | 4.92- 6.66 6.66 | YLEGTLLKP (SEQ ID NO: 229) IYLEGTLLK (SEQ ID NO: 230) | 4.87- 7.88 7.88 | IYLEGTLLK (SEQ ID NO: 230) YLEGTLLKP (SEQ ID NO: 229) | 13.40 | GTLLKPNMV (SEQ ID NO: 231) |  | no |
| ALDOAA | 238-256 | HACTQ-hcit-FSH(N) EEIAMA TVTA (SEQ ID NO: 195) | 13.18- 17.73 13.18 17.73 | TQKFSHEEI (SEQ ID NO: 232) KFSHEEIAM (SEQ ID NO: 233) | 4.11 | KFSHEEIAM (SEQ ID NO: 233) | 46.73 | TQKFSHEEI (SEQ ID NO: 232) |  | yes |
| ALDOAA | 289-307 | hcit-CPLL-hcit-PWALTFS YGRALQ (SEQ ID NO: 19) | 14.38- 19.06 19.06 | KPWALTFSY (SEQ ID NO: 234) LLKPWALTF (SEQ ID NO: 235) | 11.15- 20.21 | LLKPWALTF (SEQ ID NO: 235) | 24.99- 28.52 | CPLLKPWAL (SEQ ID NO: 236) |  | no |

Screening of ALDOA Peptide Responses

Screening was performed to identify potential homocitrullinated ALDOA epitopes in transgenic HHDII/DP4 and HHDII/DR1 mice. Mice were immunised with pools of human homocitrullinated peptides. To reduce the effect of possible cross reactivity the peptides within each pool were chosen so that they did not contain any overlapping amino acid sequences. Each pool was administered as three immunisations containing 20 μg of each peptide and CpG/MPLA as an adjuvant. After 21 days the mice were culled and the immune responses to each peptide within the immunising pool were assessed by ex vivo ELISpot in HHDII/DP4 (FIG. 4b) and HHDII/DR1 mice (FIG. 4d). Peptides spanning amino acids 74-93 (Ald 74Hcit), 140-157 (Ald 140Hcit), and 238-256 (Ald 238Hcit) all showed stimulation of IFNγ responses in HHDII/DP4 transgenic mice whereas only Ald 140Hcit stimulated responses in HHDII/DR1 transgenic mice. Our predictions therefore identified 3/5 peptides which could induce a T cell response. No responses were seen to ALDOA 74-93Hcit or 140-157 in DR4 mice (FIG. 6a). Of the responding peptides ALDOA 74-93 Hcit and 140-157 Hcit peptides are homologous in human and mice therefore these two peptides were selected for further investigation. Minimal IL-10 (FIG. 6b) or IL-17 (FIG. 6c) responses were seen to Aldolase peptides in HHDII/DP4 mice.

The responses to ALDOA 74-93 Hcit and 140-157 Hcit immunisation were characterised for cross reactivity to the wt peptide sequence. In HHDII/DP4 mice, limited responses were seen to either wt peptide with Ald 74 Hcit and Ald 140 Hcit responses significantly higher than the 74-93 wt (p<0.0001) or 140-157 wt (p<0.0001) (FIG. 7c). Thus a key characteristic of immunogenic peptides is they express homocitrulline. As with the vimentin responses those to the ALDOA peptide were significantly reduced in the presence of CD4 blocking antibodies for both ALDOA 74-93Hcit (p<0.0001) and ALDOA 140-157Hcit (p<0.0001). Thus a key characteristic of the response is it is mediated by CD4 T cells. In HHDII/DR1 mice immunised with ALDOA 140-157 Hcit IFNγ responses to Ald 140 Hcit were significantly higher than the responses to ALDOA 140-157 wt (FIG. 7d; p=0.0047). Thus a key characteristic of immunogenic peptides is they express homocitrulline.

In mammals there are three isoforms of the ALDOA enzyme, ALDOA (A); ALDOB (B) and ALDOC (C) which are encoded by three distinct genes. They are highly conserved and have a high degree of amino acid homology (FIG. 3a). ALDOA 74-93 is highly conserved in all three isotypes with only 5 amino acid difference between isotype A and β and only 4 between A and C. ALDOA 140-157 is highly conserved in all three isotypes with only 7 amino acid difference between isotype A and β and only 2 between A and C. Vimentin and ALDOA are also highly conserved between, mouse, rat, chicken, dog, sheep, cow, horse, pig and humans (FIG. 8). As the vaccine induces T cell responses in humans and mice and anti-tumour responses in mice, it can be assumed similar responses will be seen in other species.

Next, we tested if ALDOA can be carbamylated at our key residues. The recombinant protein was treated in vitro with potassium cyanate and carbamylation was assessed by ELISA. Carbamylation was significantly increased after treatment with potassium cyanate demonstrating that ALDOA contains lysines that can be subject to homocitrullination (FIG. 9a). Next, carbamylated recombinant protein sample was analysed by mass spectrometry to determine the presence of homocitrulline molecules. Mass spectrometry demonstrates that ALDOA (FIG. 9b) protein can be homocitrullinated at a number of sites. Together these results show that ALDOA could undergo carbamylation at the correct sites.

Example 3. Predictions for Identifying Homocitrulline Containing T Cell Targets

As In silico bioinformatic analysis of vimentin and ALDOA (Table 2 and 3) using IEDB prediction program (iedb.org/) identified 10 peptides but only four of these were immunogenic. We sort to combine IEDB with another prediction tool. Computer modelling was done using PEP-FOLD3, a novel computational framework hosted by the University of Paris (mobyle.rpbs.univ-paris-diderot.fr/cgi-bin/portal.py #forms: : PEP-FOLD3). The software allows both de novo free or biased prediction for linear peptides between 5 and 50 amino acids, and the generation of native-like conformations of peptides interacting with a protein when the interaction site is known in advance. Structures are calculated as a result of over 100 different simulations per peptide.

Interestingly we have shown that peptides found to give a high frequency T cell response share a common structure with a spiral like structure of at least 5 amino acids within he peptide; lack of a spiral is associated with negative responses in T cell assays. However, strong predicted MHC binding does not automatically mean a repertoire exists to the peptide, rather informs the selection of more effective peptides for further study based on high binding affinity, the presence of homocitrulline residues in the core region, the peptide having apredominately spiral conformational structure upon 3D modelling, and the existence of homology between the mouse and human sequences.

Using this combination of predictions, 5 CyK8 peptides containing homocitrulline were synthesised (Table 4). Screening was performed to identify potential homocitrullinated Cyk8 epitopes in transgenic HHDII/DP4. Mice were immunised with pools of human homocitrullinated peptides. To reduce the effect of possible cross reactivity the peptides within each pool were chosen so that they did not contain any overlapping amino acid sequences. Each pool was administered as three immunisations containing 20 μg of each peptide and CpG/MPLA as an adjuvant. After 21 days the mice were culled and the immune responses to each peptide within the immunising pool were assessed by ex vivo ELISpot in HHDII/DP4 (FIG. 10a). Peptides spanning amino acids 101-120 (Cyk8 108,117Hcit), 112-131 (CyK8 117,122,130 Hcit), 182-201 (CyK8 185,197,198 Hcit), 371-388 (CyK8 381hcit) and 381-399 (CyK8 381,393Hcit) all showed stimulation of IFNγ responses in HHDII/DP4 transgenic mice. The responses to CyK8 101-120 Hcit, 112-131 Hcit, 182-201 Hcit, 371-388 Hcit and 381-399 Hcit immunisation were characterised for cross reactivity to the wt peptide sequence. In HHDII/DP4 mice, limited cross reactive responses were seen any wt peptide with CyK8 112 Hcit, CyK371 and CyK8 381 Hcit responses significantly higher than the 112-131 wt (p<0.0001), 371-388 (p<0.0001) or 381-399 wt (p<0.01) (FIG. 10b). Thus a key characteristic of immunogenic peptides is they express homocitrulline. All of these peptides (100%) were immunogenic. Thus a high predicted HLA-DP4 binding affinity (<30), the presence of homocitrulline residues in the core region, the peptide being amphipathic in nature with a predominately spiral conformational structure upon 3D modelling, and the existence of homology between the mouse and human sequences defines immunogenicity. When this model was applied retrospectively to include the vimentin and ALDOA peptides 8/9 (88%) were correctly predicted.

Responses to Cyk8 101Hcit, 112Hcit, 371Hcit and 381Hcit were assessed in the presence of CD4 or CD8 blocking antibodies. Responses to Cyk8 101Hcit, 371Hcit and 381Hcit were inhibited upon inclusion of the CD4 blocking antibody but not with CD8 blocking antibody (FIG. 11a,d,e). Response to Cyk8 112Hcit was inhibited in the presence of CD8 blocking antibody but not with CD4 blocking antibody. (FIG. 11b). The Cyk8 112Hcit peptide sequence was analysed for predicted sequences to bind to HLA-A2 as the HHDII/DP4 mice possess HLA-A2 MHC class I allele. The shorter Cyk8 117-125Hcit peptide was tested for stimulation of immune responses in HHDII/DP4 mice and showed the generation of responses to the Cyk8 117Hcit peptide. These responses were blocked in the presence of CD8 blocking antibody but not in the presence of CD4 blocking antibody suggesting a CD8 mediated response to this peptide (FIG. 11f). Responses to homocitrullinated Cyk8 peptides show both CD4 and CD8 mediated responses in HHDII/DP4 mice.

The five selected homocitrullinated Cyk8 peptides were also screened in HHDII/DR1 transgenic mice. Significant responses were detected to Cyk8 371Hcit and 112Hcit peptides (p<0.0001) which showed minimal cross reactivity to the wt peptide sequences (p<0.002) (FIG. 12a). Response to Cyk8 112Hcit peptide in the HHDII/DR1 mice was lost in the presence of CD8 blocking antibody but less effect of the CD4 blocking antibody was seen (FIG. 12b). This response also demonstrated cross reactivity to the shorter Cyk8 117Hcit peptide (FIG. 12b). Immunisation with the shorter Cyk8 117-125Hcit peptide showed the generation of responses to the Cyk8 117Hcit peptide that cross reacted with the Cyk8 112Hcit peptide, this Cyk8 117Hcit responses was also lost in the presence of CD8 blocking antibody (FIG. 12c). Response to the Cyk8 371Hcit peptide in HHDII/DR1 mice was lost in the presence of the CD4 blocking antibody but not with the CD8 blocking antibody (FIG. 12c). Responses to the Cyk8 112Hcit and Cyk8 371Hcit could be maintained in vitro and exhibited similar response characteristics compared to ex vivo analysis further confirming the CD8 and CD4 mediated responses respectively (FIG. 12d). Responses to homocitrullinated Cyk8 peptides show both CD4 and CD8 mediated responses.

The ability of the wt peptides to stimulate a response was tested with the Cyk8 112Hcit peptide in the HHDII/DR1 mice. Cyk8 112 wt peptide was administered as three immunisations containing 25 μg of peptide and CpG/MPLA as an adjuvant. After 21 days the mice were culled and the immune responses to peptide were assessed by ex vivo ELISpot. HHDII/DR1 mice showed no specific response to the immunising Cyk8 112 wt peptide or to the Cyk8 112Hcit and Cyk8 117Hcit peptides (FIG. 12e).

Additional peptides within vimentin and ALDOA and peptides within BiP, nucleophosmin, enolase, β-catenin and HSP60 have also been identified using this motif (Table 5).

A number of peptides were chosen to test and HHDII/DP4 mice were immunised with pools of human homocitrullinated peptides. To reduce the effect of possible cross reactivity, the peptides within each pool were chosen so that they did not contain any overlapping amino acid sequences. Each pool was administered as three immunisations containing 20 µg of each peptide and CpG/MPLA as an adjuvant. After 21 days the mice were culled and the immune responses to each peptide within the immunising pool were assessed by ex vivo ELISpot (FIG. 13). Peptides from BiP spanning amino acids 316-336, 328-346 and 562-579, from nucleophosmin (Npm) spanning amino acids 11-27, 258-277 and 266-287, from enolase spanning amino acids 156-176, 245-264 and 400-419, from vimentin spanning amino acids 86-108 and 390-408 and from aldolase spanning amino acids 204-219 and 209-217 showed stimulation of IFNγ responses in HHDII/DP4 transgenic mice. The responses were characterised for cross reactivity to the wt peptide sequence. In HHDII/DP4 mice, limited cross reactive responses were seen to any wt peptide with BiP 328Hcit, 562Hcit, Npm 258Hcit, Npm 266Hcit and aldolase 204Hcit responses significantly higher than the corresponding wt peptides (p<0.05) (FIG. 13a-e). Thus the prediction model applies also to a wider peptide panel and a key characteristic of the immunogenic peptides is they express homocitrulline.

To further characterise the responses induced by the carbamylated (homocitrulline containing) peptides mice were immunised with Hcit peptides and splenocytes assessed after 7 days culture for responses to the Hcit peptide in the presence of CD4 or CD8 blocking antibodies. Responses to aldolase 204Hcit showed loss of response in the presence of both CD4 and CD8 blocking antibodies although this was partial loss of response. Thus suggesting this sequence may contain both CD4 and CD8 responses (FIGS. 13e and f). The response to the shorter aldolase 209Hcit peptide was lost in the presence of the CD8 blocking antibody suggesting a CD8 mediated response to this peptide (FIG. 13f). Responses to BiP 316Hcit, 328Hcit and 562Hcit all showed loss of response in the presence of CD4 blocking antibody but not with CD8 blocking antibody (FIG. 14a). Responses to enolase 156Hcit, 245Hcit and 400Hcit were also lost in the presence of CD4 blocking antibody but not in the presence of CD8 blocking antibody (FIG. 14b). The same loss of response in the presence of CD4 blocking antibody was seen for the vimentin 86Hcit and 390Hcit responses (FIG. 14d). The Npm responses to 11Hcit and 258Hcit also show blocking of the response in the presence of the CD4 blocking antibody but not with the CD8 blocking antibody (FIG. 14c), however the Npm 266Hcit response is lost in the presence of the CD8 blocking antibody but not with the CD4 blocking antibody (FIG. 14c).

Since responses to homocitrullinated aldolase 204-219 in HHDII/DP4 mice suggested the presence of a HHDII (HLA-A2) restricted CD8 response this peptide was tested for responses in HHDII/DR1 mice alongside the shorter 209-217 Hcit peptide that was shown to elicit a CD8 mediated response in HHDIVDP4 mice. Both peptides stimulated strong responses to the homocitrulline peptides with lower reactivity to the wt sequences in HHDIVDR1 mice (FIG. 15).

Thus a key characteristic of most responses is they are medlated by CD4 T cells. In addition, Hcit specific responses can also be mediated by CDS T cells.

TABLE 4

Homocitrulline binding predictions for CyK8.

| Protein | coordinates | sequence | DP4 prediction score | DP4 predicted cores | DR4 prediction score | DR4 predicted cores | DR1 prediction scores | DR1 predicted cores | Spiral | T cell response |
|---|---|---|---|---|---|---|---|---|---|---|
| Cyk 8 | 101-120 | KFASFID-Hcit-VRFLEQQN-Hcit-MLE (SEQ ID NO: 25) | 0.97-17.18 0.97-1.68 6.08 | IDKVRFLEQ (SEQ ID NO: 197) SFIDKVRFL (SEQ ID NO: 237) FIDKVRFLE (SEQ ID NO: 238) | 5.06 25.16-37.08 25.16-26.26 5.06-37.08 | FLEGGNKML (SEQ ID NO: 239) IDKVRFLEG (SEQ ID NO: 197) FASFIDKVR (SEQ ID NO: 240) VRFLEQQNK (SEQ ID NO: 201) | 12.27 12.27-66.46 63.29 65.13 | FLEQQNKML (SEQ ID NO: 239) VRFLEQGNK (SEQ ID NO: 201) FASFIDKVR (SEQ ID NO: 240) KVRFLEQQN (SEQ ID NO: 199) | ~~~~ | Yes |
| Cyk8 | 112-131 | LEQQN-hcit-MLET-hcit-WSLLQQQ-hcit-T (SEQ ID NO: 26) | 3.16-4.72 3.16-4.72 | KMLETKWSL (SEQ ID NO: 27) MLETKWSLL (SEQ ID NO: 241) | 12.19-24.67 12.19-15.38 12.96-15.38 24.67 | MLETKWSLL (SEQ ID NO: 241) LETKWSLLQ (SEQ ID NO: 242) KMLETKWSL (SEQ ID NO: 27) QNNMLETKW (SEQ ID NO: 243) | 31.04-44.89 44.89-46.47 31.04-44.89 | KWSLLQQQK (SEQ ID NO: 244) MLETKWSLL (SEQ ID NO: 241) LETKWSLLQ (SEQ ID NO: 242) | ~~~~ | Yes |

TABLE 4-continued

Homocitrulline binding predictions for Cyk8.

| Protein | coordinates | sequence | DP4 prediction score | DP4 predicted cores | DR4 prediction score | DR4 predicted cores | DR1 prediction scores | DR1 predicted cores | Spiral | T cell response |
|---|---|---|---|---|---|---|---|---|---|---|
| Cyk8 | 182-202 | EIN-hcit-RTEMEN EFVLI-hcit-hcit-DVDE (SEQ ID NO: 28) | | | 27.44-41.36 36.01-41.15 33.01 | MENEFVLIK (SEQ ID NO: 245) FVLIKKDVD (SEQ ID NO: 246) INKRTEMEN (SEQ ID NO: 247) | 69.5-75.9 | MENEFVLIK (SEQ ID NO: 245) | | Yes |
| Cyk 8 | 371-388 | LREYQ ELMNV-hcit-LALDIEI (SEQ ID NO: 29) | 24.36-26.69 24.36-26.69 | LMNVKLALD (SEQ ID NO: 248) ELMNVKLAL (SEQ ID NO: 249) | 4.42-5.8 5.76 | YQELMNVKL (SEQ ID NO: 250) LMNVKLALD (SEQ ID NO: 248) | 6.74-20.92 20.92 | YQELMNVKL (SEQ ID NO: 250) ELMNVKLAL (SEQ ID NO: 249) | | Yes |
| Cyk 8 | 381-399 | hcit-LALDIE IATYR-hcit-LLEGEE (SEQ ID NO: 30) | 18.10-24.62 24.62 | IEIATYRKL (SEQ ID NO: 251) IATYRKLLE (SEQ ID NO: 252) | 12.39-27.03 23.47-27.68 | LDIEIATYR (SEQ ID NO: 253) IATYRKLLE (SEQ ID NO: 252) YRKLLEGEE (SEQ ID NO: 254) | 39.89-27.66 | IEIATYRKL (SEQ ID NO: 251) | | Yes |

TABLE 5

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| ALDOAA | 198-216 | DL-Hcit-RCQYVTE-Hcit-VLAAVY-Hcit-A (SEQ ID NO: 20) | 8.92-11.09 8.92-11.09 | CQYVTEKVL (SEQ ID NO: 255) YVTEKVLAA (SEQ ID NO: 256) | 1.65-1.78 | YVTEKVLAA (SEQ ID NO: 256) | 10.18-13.7 | YVTEKVLAA (SEQ ID NO: 256) | |
| ALDOAA | 323-342 | AAQEEYV-Hcit-RALA NSLACQG-Hcit (SEQ ID NO: 21) | 45.05-55.91 52.36-56.49 45.05-52.36 | KRALANSLA (SEQ ID NO: 257) YVKRALANS (SEQ ID NO: 258) EEYVKRALA (SEQ ID NO: 259) | 7.44-7.59 7.44-7.59 7.44 | VKRALANSL (SEQ ID NO: 260) KRALANSLA (SEQ ID NO: 257) YVKRALANS (SEQ ID NO: 258) | 12.6 8.47 | VKRALANSL (SEQ ID NO: 260) KRALANSLA (SEQ ID NO: 257) | |
| ALDOAA | 208-226 | Hcit-VLAAVY-Hcit-ALSDHHIY (SEQ ID NO: 22) | 29.94-32.49 39.24-42.43 | VLAAVYKAL (SEQ ID NO: 24) YKALSDHHI (SEQ ID NO: 261) | 5.93-7.72 5.93-7.72 | YKALSDHHI (SEQ ID NO: 261) VYKALSDHH (SEQ ID NO: 262) | 5.79-6.42 6.39-6.42 | YKALSDHHI (SEQ ID NO: 261) VLAAVYKAL (SEQ ID NO: 24) | |
| ALDOAA | 204-219 | YVTEKVLAA VYKALSD (SEQ ID NO: 23) | 16.41-19.85 | VLAAVYKAL (SEQ ID NO: 24) | 3.95 10.46 | YVTEKVLAA (SEQ ID NO: 256) KVLAAVYKA (SEQ ID NO: 263) LAAVYKALS (SEQ ID NO: 264) | 15.29-20.07 1.34-20.07 14.77 | VLAAVYKAL (SEQ ID NO: 24) YVTEKVLAA (SEQ ID NO: 256) LAAVYKALS (SEQ ID NO: 264) | |

TABLE 5 -continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| Vimentin | 86-108 | FSLADAIN TEF-Hcit-NTRTNE-Hcit-VELQ (SEQ ID NO: 13) | 25.28-29.44 25.28-27.76 25.28-27.76 25.32-27.76 | AINTEFKNT (SEQ ID NO: 265) FKNTRTNEK (SEQ ID NO: 266) EFKNTRTNE (SEQ ID NO: 267) TRTNEKVEL (SEQ ID NO: 268) | 4.34-4.52 17.84-19.26 | FKNTRTNEK (SEQ ID NO: 266) INTEFKNTR (SEQ ID NO: 269) | 73.49 73.49-79.9 73.49 | EFKNTRTNE (SEQ ID NO: 267) NTEFKNTRT (SEQ ID NO: 270) FKNTRTNEK (SEQ ID NO: 266) | |
| Vimentin | 390-408 | Hcit-MALDIEIA TYR-Hcit-LLEGEE (SEQ ID NO: 14) | 18.19-24.62 24.62 | IEIATYRKL (SEQ ID NO: 251) IATYRKLLE (SEQ ID NO: 252) | 23.74-27.68 27.68 | IATYRKLLE (SEQ ID NO: 252) YRKLLEGEE (SEQ ID NO: 254) | 40.8-57.66 | IEIATYRKL (SEQ ID NO: 251) | |
| Cytokeratin 8 | 120-140 | ET-Hcit-WSLLQQQ-Hcit-TARSNMDNMF (SEQ ID NO: 31) | 55.49 55.49-75.39 63.26-87.43 | ETKWSLLQQ (SEQ ID NO: 271) WSLLQQQKT (SEQ ID NO: 272) LQQQKTARS (SEQ ID NO: 273) | 0.5-2.17 | LQQQKTARS (SEQ ID NO: 273) | 8.47-13.91 9.25-63.26 8.47-13.91 | KWSLLQQQK (SEQ ID NO: 244) LQQQKTARS (SEQ ID NO: 273) WSLLQQQKT (SEQ ID NO: 272) | |
| Cytokeratin 8 | 93-112 | EQI-Hcit-SLNN-Hcit-FASFID-Hcit-VRFL (SEQ ID NO: 32) | 19.63-25.41 19.63-27.86 | KFASFIDKV (SEQ ID NO: 274) SLNNKFASF (SEQ ID NO: 275) | 1.98-5.39 17.73-20.24 | IKSLNNKFA (SEQ ID NO: 276) FASFIDKVR (SEQ ID NO: 240) LNNKFASFI (SEQ ID NO: 277) | 11.25-20.28 11.25-20.24 49.25 | IKSLNNKFA (SEQ ID NO: 276) LNNKFASFI (SEQ ID NO: 277) | |
| Cytokeratin 8 | 190-208 | ENEFVLI-Hcit-Hcit-DVDEAYMN-Hcit-V (SEQ ID NO: 33) | 67.48-75.49 67.48-67.96 | FVLIKKDVD (SEQ ID NO: 246) EFVLIKKDV (SEQ ID NO: 278) | 11.45 11.45 | IKKDVDEAY (SEQ ID NO: 279) FVUKKDVD (SEQ ID NO: 246) | 78.64-86.64 78.64-84.99 | KKDVDEAYM (SEQ ID NO: 280) FVLIKKDVD (SEQ ID NO: 246) | |
| Cytokeratin 8 | 294-310 | G-Hcit-HGDDLRRT-Hcit-TEISEM (SEQ ID NO: 34) | 72.15-81.41 | LRRTKTEIS (SEQ ID NO: 281) | 3.19-3.29 | LRRTKTEIS (SEQ ID NO: 281) | 76.17-85.76 76.17-85.34 | LRRTKTEIS (SEQ ID NO: 281) RRTKTEISE (SEQ ID NO: 282) | |
| Cytokeratin 8 | 369-388 | RQLREYQEL MNV-Hcit-LALDIEI (SEQ ID NO: 283) | 24.36-26.78 24.36-26.78 | ELMNVKLAL (SEQ ID NO: 249) LMNVKLALD (SEQ ID NO: 248) | 4.42-5.82 | YQELMNVKL (SEQ ID NO: 250) | 6.6-20.92 6.74-20.92 | YQELMNVKL (SEQ ID NO: 250) ELMNVKLAL (SEQ ID NO: 249) | |
| Cytokeratin 8 | 320-338 | EiEGL-Hcit-GQRASLE AAIADA (SEQ ID NO: 36) | 59.6-65.73 | LKGQRASLE (SEQ ID NO: 284) | 13.22 | LKGQRASLE (SEQ ID NO: 284) | 8.36-13.25 8.36-8.42 | LKGQRASLE (SEQ ID NO: 284) IEGLKGQRA (SEQ ID NO: 285) | |

TABLE 5 -continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| Cytokeratin 8 | 339-358 | EQRGELAS-Hcit-DANA-Hcit-LSELEA (SEQ ID NO: 37) | 75.97-77.15 95.14-96.26 95.14-95.26 | DANAKLSEL 13.67 (SEQ ID NO: 286) LAIKDANAK (SEQ ID NO: 287) AIKDANAKL (SEQ ID NO: 288) | 13.67-13.76 | IKDANAKLS 27.63-(SEQ ID 49.46 NO: 289) AIKDANAKL 49.46 (SEQ ID NO: 288) | 27.63-49.46 | IKDANAKLS (SEQ ID NO: 289) LAIKDANAK (SEQ ID NO: 287) | 〰〰〰 |
| BiP | 104-124 | NDPSVQQDI-Hcit-FLPF-Hcit-VVE-Hcit-Hcit-T (SEQ ID NO: 38) | 3.13-5.48 3.13-3.36 3.62-7.91 | IKFLPFKVV 8.87-8.95 (SEQ ID 8.88-NO: 290) 29.27 QDIKFLPFK 22.3-(SEQ ID 30.85 NO: 291) 22.3-QQDIKFLPF 29.27 (SEQ ID NO: 292) | | FLPFKVVEK 26.97-(SEQ ID 54.82 NO: 293) 26.97 DIKFLPFKV 81.79 (SEQ ID NO: 294) VQQDIKFLP (SEQ ID NO: 295) IKFLPFKVV (SEQ ID NO: 290) | | DIKFLPFKV (SEQ ID NO: 294) IKFLPFKVV (SEQ ID NO: 290) SVQQDIKFL (SEQ ID NO: 296) | |
| BiP | 144-159 | EiSAMVLT-Hcit-M-Hcit-ETAEA (SEQ ID NO: 39) | 42.22-42.30 42.22-42.30 | MVLTKMKET 8.68-8.69 (SEQ ID NO: 297) SAMVLSKMK (SEQ ID NO: 298) | | ISAMVLTKM 36.03 (SEQ ID NO: 299) | 36.03 | ISAMVLTKM (SEQ ID NO: 299) LTKMKETAE (SEQ ID NO: 300) | 〰〰〰 |
| BiP | 255-275 | GEDFDQR VMEHFI-Hcit-LY-Hcit-Hcit-TG (SEQ ID NO: 40) | 7.94-12.95 12.95 | RVMEHFIKL 17.21 (SEQ ID 17.21-NO: 301) 40.78 QRVMEHFIK (SEQ ID NO: 302) | | FIKLYKKKT 32.16-(SEQ ID 38.72 NO: 303) 38.72-VMEHFIKLY 65.12 (SEQ ID NO: 304) | | FIKLYKKKT (SEQ ID NO: 303) QRVMEHFIK (SEQ ID NO: 302) | 〰〰〰 |
| BiP | 286-306 | Q-Hcit-LRREVE-Hcit-A-Hdt-RALSSQ HQAR (SEQ ID NO: 41) | 70.38-84.43 78.03-85.41 83.26-85.26 | KRALSSQHQ 15.95-(SEQ ID 19.49 NO: 305) 19.45-EKAKRALSS 23.67 (SEQ ID 23.67 NO: 306) 23.67 LRREVEKAK (SEQ ID NO: 307) | | LRREVEKAK 34.03-(SEQ ID 65.3 NO: 307) 34.03-VEKAKRALS 65.3 (SEQ ID 34.03-NO: 308) 39.52 AKRALSSQH 43.46-(SEQ ID 45.85 NO: 309) 43.46-KRALSSQHQ 56.99 (SEQ ID NO: 305) | | AKRALSSQH (SEQ ID NO: 309) VEKAKRALS (SEQ ID NO: 308) KRALSSQHQ (SEQ ID NO: 305) KLRREVEKA (SEQ ID NO: 310) REVEXAKRA (SEQ ID NO: 311) | 〰〰〰 |
| BiP | 316-336 | EDFSETLTRA-Hcit-FEELNM DLFR (SEQ ID NO: 42) | 0.13-1.31 | LTRAKFEEL 11.45-(SEQ ID 15.14 NO: 312) 21.98-31.82 21.98-31.82 | | FSETLTRAK 53.82-(SEQ ID 68.1 NO: 313) 54.2-RAKFEELNM 65.21 (SEQ ID 57.7-NO: 314) 77.4 LTRAKFEEL (SEQ ID NO: 312) | | FEELNMDLF (SEQ ID NO: 315) SETLTRAKF (SEQ ID NO: 316) LTRAKFEEL (SEQ ID NO: 312) | 〰 |

TABLE 5-continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| BiP | 328-346 | EELNMDL FRSTM-Hcit-PVQ-Hcit-VL (SEQ ID NO: 43) | 19.99-23.39 21.61-23.39 | LFRSTMKPV (SEQ ID NO: 317) FRSTMKPVQ (SEQ ID NO: 318) | 6.65-13.67 6.65-8.29 | MDLFRSTMK (SEQ ID NO: 319) FRSTMKPVQ (SEQ ID NO: 318) | 28.99-39.69 35.68-36.69 28.99 | LFRSTMKPV (SEQ ID NO: 317) MDLFRSTMK (SEQ ID NO: 319) FRSTMKPVQ (SEQ ID NO: 318) | |
| BiP | 367-387 | RIP-Hdt-IQQLV-Htit-EFFNG-Hcit-EPSRG (SEQ ID NO: 44) | 4.15-27.73 4.15-20.84 | QLVKEFFNG (SEQ ID NO: 320) LVKEFFNGK (SEQ ID NO: 321) | 9.73 9.73-24.14 15.33-24.14 | FFNGKEPSR (SEQ ID NO: 322) LVKEFFNGK (SEQ ID NO: 321) IQQLVKEFF (SEQ ID NO: 323) | 47.06-62.09 65.99-73.97 71.21-73.97 | FFNGKEPSR (SEQ ID NO: 322) IQQLVKEFF (SEQ ID NO: 323) LVKEFFNGK (SEQ ID NO: 321) | |
| BiP | 460-480 | TVTI-Hcit-WEGERPLT-Hcit-DNHLLG (SEQ ID NO: 45) | 17.85-20.08 17.85-51.73 | KVYEGERPL (SEQ ID NO: 324) YEGERPLTK (SEQ ID NO: 325) | 10.02-27.01 | YEGERPLTK (SEQ ID NO: 325) | 44.67-63.59 44.67-65.03 | KVYEGERPL (SEQ ID NO: 324) YEGERPLTK (SEQ ID NO: 325) | |
| BiP | 562-579 | RNELESYAYSL-Hcit-NQIGD-Hcit (SEQ ID NO: 46) | 21.01 21.01 | LESYAYSLK (SEQ ID NO: 326) YAYSLKNQI (SEQ ID NO: 327) | 12.81-14.01 | YAYSLKNQI (SEQ ID NO: 327) LESYAYSLK (SEQ ID NO: 326) | 32.42-43.8 32.42-43.8 | YAYSLKNQI (SEQ ID NO: 327) AYSLKNQIG (SEQ ID NO: 328) | |
| BiP | 620-639 | Hcit-Hcit-ELEEIVQPIIS-Hcit-LYGSAG (SEQ ID NO: 47) | 32.06-47.49 39.29-47.49 | IVQPIISKL (SEQ ID NO: 329) VQPIISKLY (SEQ ID NO: 330) | 6.28-7.76 7.72-19.66 | VQPIISKLY (SEQ ID NO: 330) IVQPIISKL (SEQ ID NO: 329) | 25.51-36.44 25.51-26.88 | IVQPIISKL (SEQ ID NO: 329) VQPIISKLY (SEQ ID NO: 330) | |
| Nucleophosmin | 11-27 | PLRPQNYLFG CEL-Hcit-AD-Hcit- (SEQ ID NO: 48) | 26.13-33.98 26.54 | YLFGCELKA (SEQ ID NO: 331) LFGCELKAD (SEQ ID NO: 332) | 10.18-10.36 10.18-10.2 | YLFGCELKA (SEQ ID NO: 331) LRPQNYLFG (SEQ ID NO: 33) | 41.72-42.71 | YLFGCELKA (SEQ ID NO: 331) | |
| Nucleophosmin | 68-89 | EGSPI-Hcit-VTLATL-Hcit-MSVQPTVSL (SEQ ID NO: 49) | 32.93 33.41-45.82 32.93 33.41-40.80 | KMSVQPTVS (SEQ ID NO: 339) KVTLATLKM (SEQ ID NO: 334) LKMSVQPTV (SEQ ID NO: 335) TLATLKMSV (SEQ ID NO: 336) | 5.42-6.05 5.15-12.57 5.5-7.38 7.38-12.57 | KVTLATLKM (SEQ ID NO: 334) LKMSVQPTV (SEQ ID NO: 335) IKVTLATLK (SEQ ID NO: 337) LATLKMSVQ (SEQ ID NO: 338) | 17.14-18.61 19.12-33.26 18.61-20.48 17.14-20.48 | KMSVQPTVS (SEQ ID NO: 339) KVTLATLKM (SEQ ID NO: 334) LATLKMSVQ (SEQ ID NO: 338) TLKMSVQPT (SEQ ID NO: 340) | |
| Nucleophosmin | 129-149 | EEEDV-Hcit-LLSISG-Hcit-RSAPGGGS (SEQ ID NO: 50) | 65.37-77.59 66.93-77.59 65.37-75.07 | LLSISGKRS (SEQ ID NO: 341) ISGKRSAPG (SEQ ID NO: 342) KLLSISGKR (SEQ ID NO: 343) | 4.11 4.11-9.89 9.89 | VKILSISGK (SEQ ID NO: 344) LLSISGKRS (SEQ ID NO: 341) ISGKRSAPG (SEQ ID NO: 342) | 5.03-17.94 | LLSISGKRS (SEQ ID NO: 341) | |

TABLE 5-continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| Nucleophosmin | 222-240 | S-Hcit-GQESF-Hcit-Hcit-QE-Hcit-TP-Hcit-TP-Hcit-G (SEQ ID NO: 51) | 73.23-91.45 73.23-85.41 82.11-85.41 | FKKQEKTPK (SEQ ID NO: 345) ESFKKQEKT (SEQ ID NO: 346) KKQEKTPKT (SEQ ID NO: 347) | 13.76 | FKKQEKTPK (SEQ ID NO: 345) | 76.73-78.7 76.73-78.7 | FKKQEKTPK (SEQ ID NO: 345) KKQEKTPKT (SEQ ID NO: 347) |  |
| Nucleophosmin | 258-277 | GGSLP-Hcit-VEA-Hcit-FINYV-Hcit-NCFR (SEQ ID NO: 52) | 24.31-30.51 24.31-30.51 28.92-30.51 | KVEAKFINY (SEQ ID NO: 348) VEAKFINYV (SEQ ID NO: 349) FINYVKNCF (SEQ ID NO: 350) | 14.7-25.2 25.2-34.52 31.9-43.83 25.2-43.83 | FINYVKNCF (SEQ ID NO: 350) EAKFINYVK (SEQ ID NO: 351) | 51.23-60.28 51.23-59.06 | VEAKFINYV (SEQ ID NO: 349) LPKVEAKFI (SEQ ID NO: 352) VEAKFINYV (SEQ ID NO: 349) |  |
| Nucleophosmin | 266-287 | A-Hcit-FINYV-Hcit-NCFRMTDQEAIQDL (SEQ ID NO: 53) | 2.93-3.06 2.93-14.95 | KFINYVKNC (SEQ ID NO: 353) YVKNCFRMT (SEQ ID NO: 354) | 11.37 15.24-21.39 11.37-20.77 | FINYVKNCF (SEQ ID NO: 350) YVKNCFRMT (SEQ ID NO: 354) INYVKNCFR (SEQ ID NO: 355) | 40.86-50.73 55.78 | FINYVKNCF (SEQ ID NO: 350) YVKNCFRMT (SEQ ID NO: 354) |  |
| Alpha Enolase | 1-16 | MSIL-Hcit-IHAREIFDSRG (SEQ ID NO: 54) | 26.7-29.02 26.7-29.02 | ILKIHAREI (SEQ ID NO: 356) LKIHAREIF (SEQ ID NO: 357) | 14.35-25.75 14.35 | ILKIHAREI (SEQ ID NO: 356) MSILKIHAR (SEQ ID NO: 358) | 17.82 17.82-35.56 | MSILKIHAR (SEQ ID NO: 358) ILKIHAREI (SEQ ID NO: 356) |  |
| Alpha Enolase | 52-69 | ND-Hcit-TRYMG-Hcit-GVS-Hcit-AVEHI (SEQ ID NO: 55) | 59.77-60.48 59.77-68.62 | KTRYMGKGV (SEQ ID NO: 359) YMGKGVSKA (SEQ ID NO: 360) | 10.02-10.25 10.25 10.02-10.25 | MGKGVSKAV (SEQ ID NO: 361) RPMGKGVSK (SEQ ID NO: 362) YMGKGVSKA (SEQ ID NO: 360) | 21.68-25.27 21.68-23.87 | YMGKGVSKA (SEQ ID NO: 360) KTRYMGKGV (SEQ ID NO: 359) |  |
| Alpha Enolase | 100-121 | TEN-Hcit-S-Hcit-FGANAILGVSLAVC-Hcit-A (SEQ ID NO: 56) | 13.21-26.83 | KFGANAILG (SEQ ID NO: 363) | 11.17 | KFGANAILG (SEQ ID NO: 363) | 12.06-24.07 | KSKFGANAI (SEQ ID NO: 364) |  |
| Alpha Enolase | 156-176 | GSHAGN-Hcit-LAMQEFMILPVGAA (SEQ ID NO: 57) | 1.2-22.16 22.16 | KLAMQEFMI (SEQ ID NO: 365) HAGNKLAMQ (SEQ ID NO: 366) | 12.67-32.56 | KLAMQEFMI (SEQ ID NO: 365) | 34.28-46.65 | KLAMQEFMI (SEQ ID NO: 365) |  |

TABLE 5 -continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| Alpha Enolase | 179-197 | REAMRIGA EVYHNL-Hcit-NVI-Hcit- (SEQ ID NO: 58) | 25.95-28.39 | VYHNLKNVI (SEQ ID NO: 367) | 3.51-30.06 3.51 | VYHNLKNVI (SEQ ID NO: 367) YHNLKNVIK (SEQ ID NO: 368) | 52.39 12.91 | VYHNLKNVI (SEQ ID NO: 367) YHNLKNVIK (SEQ ID NO: 368) | |
| Alpha Enolase | 194-212 | NVI-Hcit-E-Hcit-YG-Hcit-DATNVGDEGG (SEQ ID NO: 59) | 83.85-94.96 83.85-85.66 92.59-94.96 | YGKDATNVG (SEQ ID NO: 369) VIKEKYGKD (SEQ ID NO: 370) KYGKDATNV (SEQ ID NO: 371) | 3.14-3.29 | YGKDATNVG (SEQ ID NO: 369) | 72.08-72.12 72.08-72.12 | KYGKDATNV (SEQ ID NO: 371) YGKDATNVG (SEQ ID NO: 369) | |
| Alpha Enolase | 245-264 | DVAASEFF RSG-Hcit-YDLDF-Hcit-SP (SEQ ID NO: 60) | 10.04-19.07 10.04-19.07 | FRSGKYDLD (SEQ ID NO: 372) FFRSGKYDL (SEQ ID NO: 373) | 22.59-24.17 38.34 | FRSGKYDLD (SEQ ID NO: 372) SEFFRSGKY (SEQ ID NO: 374) | 54.29-81.42 54.29-81.42 81.42 69.53-81.42 | FRSGKYDLD (SEQ ID NO: 372) FFRSGKYDL (SEQ ID NO: 373) SEFFRSGKY (SEQ ID NO: 374) ASEFFRSGK (SEQ ID NO: 375) | |
| Alpha Enolase | 273-291 | PDQLADLY-Hcit-SFI-Hcit-DYPVVS (SEQ ID NO: 61) | 19.25-24.65 19.25-22.11 20.41-24.65 | ADLYKSFIK (SEQ ID NO: 376) DLYKSFIKD (SEQ ID NO: 377) LYKSFIKDY (SEQ ID NO: 378) | 2.4-22.77 2.4 22.03-27.67 27.67 | YKSFIKDYP (SEQ ID NO: 379) FIKDYPVVS (SEQ ID NO: 380) LYKSFIKDY (SEQ ID NO: 378) LADLYKSFI (SEQ ID NO: 381) | 40.44 63.72-66.68 60.86-66.68 40.44 | KSFIKDYPV (SEQ ID NO: 382) LADLYKSFI (SEQ ID NO: 381) ADLYKSFIK (SEQ ID NO: 376) FIKDYPVVS (SEQ ID NO: 380) | |
| Alpha Enolase | 301-317 | WGAWQ-Hcit-FTASAGIQWG (SEQ ID NO: 62) | 26.6-30 | KFTASAGIQ (SEQ ID NO: 383) | 5.6-9.22 | WQKFTASAG (SEQ ID NO: 384) | 6.34 6.34 | WQKFTASAG (SEQ ID NO: 384) AWQKFTASA (SEQ ID NO: 385) | |
| Alpha Enolase | 333-352 | NE-Hcit-SCNCLLL-Hcit-VNQIGSVTE (SEQ ID NO: 386) | 39.34-62.75 39.34-42.6 39.34-62.75 | CLLLKVNQI (SEQ ID NO: 387) LLKVNQIGS (SEQ ID NO: 388) SCNCLLLKV (SEQ ID NO: 389) | 9.38-19.95 12.48-19.95 | LLKVNQIGS (SEQ ID NO: 388) CLLLKVNQI (SEQ ID NO: 387) | 14.35-15.37 | CLLLKVNQI (SEQ ID NO: 387) | |
| Alpha Enolase | 400-419 | RSERLA-Hcit-YNQLLRI EEELGS (SEQ ID NO: 64) | 11.8-12.36 11.8-18.57 | RLAKYNQLL (SEQ ID NO: 390) AKYNQLLRI (SEQ ID NO: 391) | 23.15-31.22 | LAKYNQLLR (SEQ ID NO: 392) | 45.27-52.87 58.12-59.75 | RLAKYNQLL (SEQ ID NO: 390) AKYNQLLRI (SEQ ID NO: 391) | |

TABLE 5 -continued

Homocitrulline binding predictions for Vimentin, ALDOA, cytokeratin 8, Bip, NPM, enolase, βcatenin and HSP60.

| Protein | coordi-nates | sequence | DP4 pre-diction score | DP4 predicted cores | DR4 Prediction score | DR4 predicted cores | DR1 pre-diction scores | DR1 predicted cores | Spiral |
|---|---|---|---|---|---|---|---|---|---|
| Alpha Enolase | 418-434 | GS-Hcit-A-Hcit-FAGRNF RNPLA-Hcit-(SEQ ID NO: 65) | 16.18-19.61 16.18 | KAKFAGRNF (SEQ ID NO: 393) KFAGRNFRN (SEQ ID NO: 394) | 19.53-33.35 | KFAGRNFRN (SEQ ID NO: 394) | 76.13 | KFAGRNFRN (SEQ ID NO: 394) |  |
| Beta catenin | 127-144 | EPSQML-Hcit-HA VVNLINYQD (SEQ ID NO: 66) | 33.28-41.88 33.28-41.88 | LKHAWNLI (SEQ ID NO: 395) MLKHAVVNL (SEQ ID NO: 396) | 3.3-3.45 | LKHAWNLI (SEQ ID NO: 395) | 16.66-22.24 16.66-19.78 | LKHAWNLI (SEQ ID NO: 395) AWNLINYQ (SEQ ID NO: 397) |  |
| Beta catenin | 334-354 | E-Hdt-LLVvTTSRVL-Hdt-VLSVCSSN-Hcit (SEQ ID NO: 67) | 0.74-12.86 10.61-61.82 | WTTSRVLKV (SEQ ID NO: 398) ITSRVLKVL (SEQ ID NO: 399) | 1.86-4.47 1.88-4.47 4.77-7.6 | VLKVLSVCS (SEQ ID NO: 400) LKVLSVCSS (SEQ ID NO: 401) WTTSRVLKV (SEQ ID NO: 398) | 9.62 9.62-17.94 12.82-17.94 12.82-15.58 | KLLWTTSRV (SEQ ID NO: 402) WTTSRVLKV (SEQ ID NO: 398) SRVIKVLSV (SEQ ID NO: 403) VLKVLSVCS (SEQ ID NO: 400) |  |
| Beta catenin | 258-275 | TLHNLLI HQEGA-Hcit-MAVRL (SEQ ID NO: 68) | 55.35-73.17 | LLHQEGAKM (SEQ ID NO: 404) | 5.06 5.06 | LLHQEGAKM (SEQ ID NO: 405) LHQEGAKMA (SEQ ID NO: 405) | 12.43 12.43-13.1 | LHQEGAKMA (SEQ ID NO: 405) LLHQEGAKM (SEQ ID NO: 404) |  |
| Beta catenin | 269-288 | A-Hcit-MAVRLAGGLQ-Hcit-MVALLN-Hcit (SEQ ID NO: 69) | 18.5-35.63 18.5-32.91 18.5-35.63 32.91 | LQKMVALLN (SEQ ID NO: 406) LAGGLQKMV (SEQ ID NO: 407) GLQKMVALL (SEQ ID NO: 408) VRLAGGLQK (SEQ ID NO: 409) | 4.73-7.08 4.73-31.97 30.74-31.35 | LQKMVALLN (SEQ ID NO: 406) VRLAGGLQK (SEQ ID NO: 409) LAGGLQKMV (SEQ ID NO: 410) | 26.97 19.62-27.23 23.3-26.97 26.97 | GLQKMVALL (SEQ ID NO: 408) VRLAGGLQK (SEQ ID NO: 409) LAGGLQKMV (SEQ ID NO: 407) LQKMVALLN (SEQ ID NO: 406) |  |
| Beta catenin | 288-307 | -Hcit-TNV-Hcit-FLAITTDC LQILAYG (SEQ ID NO: 70) | | | | | 8.87-10.9 | NVKFLAITT (SEQ ID NO: 410) |  |
| Beta catenin | 332-349 | TYE-Hcit-LLWTTSRVL-Hcit-VLSV (SEQ ID NO: 71) | 0.73-1.12 | WTTSRVLKV (SEQ ID NO: 398) | 3.19-7.23 3.24 | WTTSRVLKV (SEQ ID NO: 398) YEKLLWTTS (SEQ ID NO: 411) | 9.62-11.15 9.62 | KLLWTTSRV (SEQ ID NO: 402) WHSRVLKV (SEQ ID NO: 398) |  |

TABLE 5 -continued

Homocitrulline binding predictions for Vimentin, ALDOA, cytokeratin 8, Bip, NPM, enolase, βcatenin and HSP60.

| Protein | coordinates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| Beta catenin | 340-358 | TSRVL-Hcit-VLSVCSSN-Hcit-PAIV (SEQ ID NO: 72) | 59.83-63.44 48.36-66.69 59.83-69.02 | LKVLSVCSS (SEQ ID NO: 401) KVLSVCSSN (SEQ ID NO: 812) RVLKVLSVC (SEQ ID NO: 412) | 1.6-1.88 1.6-1.88 | VLSVCSSNK (SEQ ID NO: 413) LVSVCSS (SEQ ID NO: 401) | 12.82-34.92 12.82-34.92 12.82-15.54 | LKVLSVCSS (SEQ ID NO: 401) VLKVLSVCS (SEQ ID NO: 400) SRVLKVLSV (SEQ ID NO: 403) | |
| Beta catenin | 478-497 | | | | | | | | |
| Beta catenin | 489-506 | YGLPVW-Hcit-LLHPPSH WPL (SEQ ID NO: 73) | 43.17-61.12 43.17-49.37 61.92 | PVVVKLLMP (SEQ ID NO: 414) LPVVVKLLH (SEQ ID NO: 415) VVVKLLHPP (SEQ ID NO: 416) | 4.66-4.96 | VVKLLHPPS (SEQ ID NO: 417) | 16.56-20.53 16.56-20.53 | VVKLLHPPS (SEQ ID NO: 417) VKLLHPPSH (SEQ ID NO: 418) | |
| Beta catenin | 503-522 | HWPLI-Hcit-ATVGLIRNL ALCPA (SEQ ID NO: 74) | 12.35-30.05 12.35-30.05 | IKATVGLIR (SEQ ID NO: 419) LIKATVGLI (SEQ ID NO: 420) | 10.06-13.34 | WPLIKATVG (SEQ ID NO: 421) | 22.88-24.83 22.88 | LIKATVGLI (SEQ ID NO: 420) HWPLIKATV (SEQ ID NO: 422) | |
| Beta catenin | 607-625 | LENIQRVAA GVLCELAQD-Hcit- (SEQ ID NO: 75) | | | 39.59 | VLCELAQDK (SEQ ID NO: 423) | | | |
| Beta catenin | 650-667 | GVATYAAA VLFRMSED-Hcit-P (SEQ ID NO: 76) | | | 9.35-12.15 | VLFRMSEDK (SEQ ID NO: 424) | | | |
| HSP60 | 117-136 | TVLARSIA-Hcit-EGFE-Hcit-IS-Hcit-GAN (SEQ ID NO: 78) | 8.56-21.55 | IAKEGFEKI (SEQ ID NO: 425) | 21.85-52.27 21.85-42.65 31.74 | IAKEGFEKI (SEQ ID NO: 425) LARSIAKEG (SEQ ID NO: 426) EGFEKISKG (SEQ ID NO: 427) | 45.06-65.33 71.85-83.97 71.85-83.97 | VLARSIAKE (SEQ ID NO: 428) LARSIAKEG (SEQ ID NO: 426) SIAKEGFEK (SEQ ID NO: 429) RSIAKEGFE (SEQ ID NO: 430) | |

TABLE 5 -continued

Homocitrulline binding predictions for Vimentin, ALDOA, cytokeratin 8, Bip, NPM, enolase, βcatenin and HSP60.

| Protein | coordi-nates | sequence | DP4 prediction score | DP4 predicted cores | DR4 Prediction score | DR4 predicted cores | DR1 prediction scores | DR1 predicted cores | Spiral |
|---|---|---|---|---|---|---|---|---|---|
| HSP60 | 280-299 | GEALSTLV LNRL-Hcit-VGLQVVA (SEQ ID NO: 79) | 10.52-13.78 19.17-27.64 19.17-27.64 23.62-27.64 | STLVLNRLK (SEQ ID NO: 431) RLKVGLQVV (SEQ ID NO: 432) LVLNRLKVG (SEQ ID NO: 433) TLVLNRLKV (SEQ ID NO: 434) | 7-7.76 11.03-13.12 | LVLNRLKVG (SEQ ID NO: 433) LNRLKVGLQ (SEQ ID NO: 435) | 19.9-22.24 22.24 | LNRLKVGLQ (SEQ ID NO: 435) TLVLNRLKV (SEQ ID NO: 434) | |
| HSP60 | 381-398 | TTSEYE-Hcit-E-Hcit-LNERLA-Hcit-LS (SEQ ID NO: 80) | 18.89-23.14 29.24 18.89-29.24 | KLNERLAKL (SEQ ID NO: 436) TTSEYEKEK (SEQ ID NO: 437) YEKEKLNER (SEQ ID NO: 438) | 27.33-36.43 27.33 | YEKEKLNER (SEQ ID NO: 438) KLNERLAKL (SEQ ID NO: 436) | 51.23-59.99 74.42-77.04 51.23-77.04 | KLNERLAKL (SEQ ID NO: 436) YEKEKLNER (SEQ ID NO: 438) KEKLNERLA (SEQ ID NO: 439) | |
| HSP60 | 517-536 | GIIDPTV-Hcit-VRTALLD AAGVA (SEQ ID NO: 81) | 18.25-30.13 18.25-30.13 | KVVRTALLD (SEQ ID NO: 440) TKVVRTALL (SEQ ID NO: 441) | 14.63-17.84 17.84 | TKVVRTALL (SEQ ID NO: 441) IDPTKVVRT (SEQ ID NO: 442) | 15.82-21.8 20.49-21.8 21.19 | PTKVVRTAL (SEQ ID NO: 443) TKVVRTALL (SEQ ID NO: 441) IDPTKVVRT (SEQ ID NO: 442) | |
| HSP60 | 84-103 | IDL-Hcit-D-Hcit-Y-Hcit-NIGA-Hcit-LVQDVAN (SEQ ID NO: 77) | 50.61-63.16 50.61-63.16 | YKNIGAKLV (SEQ ID NO: 444) KNIGAKLVQ (SEQ ID NO: 445) | 4.84-11.64 | YKNIGAKLV (SEQ ID NO: 444) | 0.42-2.37 0.42-2.37 | KYKNIGAKL (SEQ ID NO: 446) YKNIGAKLV (SEQ ID NO: 444) | |

Example 4. Responses in Healthy Human Donors and Cancer Patients

Determination as to the existence of a repertoire of T cells for carbamylated epitopes in humans was investigated using PBMCs from normal, healthy donors. PBMCs were isolated and CD25-depleted. Cells were labelled with CFSE and proliferation was monitored after stimulation with homocitrulline peptides. Example plots are shown for one healthy donor and one lung cancer patient (FIG. 106 a and b). Most healthy donors tested showed a CD4+ T cell proliferative response that was above twice the background for at least one of the peptides tested (FIG. 16 c and e). Across the healthy donors, ALDOA 74-93Hcit (p=0.0079), ALDOA 140-157 Hcit (p=0.0122) and vimentin 116-135Hcit (p<0.0001) induced significant CD4 proliferation. In conclusion, healthy donors show a repertoire of CD4 T cells that can respond to the carbamylated peptides.

In addition to healthy donors (Table 6a) we examined the repertoire of responses in three ovarian, one breast and seven lung cancer patients (Table 6b). Seven of eleven patients tested showed proliferative CD4 responses to one or more of the carbamylated peptides (FIG. 16 d and f). Across the patients, ALDOA 74-93 Hcit (p=0.0353) induced significant proliferative responses when compared to the media only control. Vimentin 116-135 Hcit responses were just short of significance (p=0.0605) This suggests that cancer patients also have repertoires of CD4 T cells that are capable of responding to the carbamylated peptides and would support the targeting of carbamylated vimentin and ALDOA for cancer therapy. The proliferative responses were predominantly CD4 mediated as shown in FIG. 16d.

Analysis of cytokine expression was also performed on majority of donors (example plots shown FIG. 17a). For each peptide, the donors that showed proliferative responses above twice the background were assessed for expression of CD134, IFNγ and GraB. The percentage of proliferating CD4 cells expressing each marker was determined. This staining showed variable expression of these markers, however the detection of IFNγ, granzyme B and CD134 suggest that these cells are a cytotoxic Th1 phenotype (FIGS. 17b and c).

Determination as to the existence of a repertoire of T cells for carbamylated Cyk8 epitopes in humans was investigated using PBMCs from seven normal, healthy donors. PBMCs were isolated and CD25-depleted. Cells were labelled with CFSE and proliferation was monitored after stimulation with Cyk8 Hcit peptides. Most healthy donors tested showed a CD4+ T cell proliferative response that was above twice the background for at least one of the peptides tested (FIG. 18).

In conclusion, healthy donors show a repertoire of CD4 T cells that can respond to the carbamylated Cyk8 peptides.

TABLE 6

Details of healthy donors and cancer patients
A. Healthy Donors

| ID | Sex | HLA type |
|---|---|---|
| BD0015 | F | HLA-A: *03, *24, HLA-B: *07, *15, HLA-C: *03, *07, HLA-DR: *04, *15, HLA-DQ: *03, *06, HLA-DP: *04 |
| BD0022 | F | HLA-A: *01, *02, HLA-B: *35, *50, HLA-C: *06, *12, HLA-DR: *04, *07, HLA-DQ: *02, *03, HLA-DP: *02, *04 |
| BD0041 | F | HLA-A: *01, *24, HLA-B: *07*40, HLA-C: *03*07, HLA-DR: *04*11, HLA-DQ: *03, HLA-DP: *02*04 |
| BD0050 | F | HLA-A: *24, *26, HLA-B: *35*45, HLA-C: *04*06, HLA-DR: *07*11, *52b, *53a, HLA-DQ: *02*03, HLA-DP: *02*04 |
| BD0010 | F | HLA-A: *02, *11, HLA-B: *40*44, HLA-C: *03*16, HLA-DR: *13, *16, *52c, *51 b, HLA-DQ: *05*06, HLA-DP: *04*10 |
| BD0095 | M | Not available |
| BD0017 | F | Not available |
| BD0001 | M | HLA-A: *02, *32, HLA-B: *8, *44, HLA-C: N/A, HLA-DR: *03, *07, HLA-DQ: *02, HLA-DP: N/A |
| BD0051 | F | HLA-A: *11, *68, HLA-B: *07*15, HLA-C: *05*07, HLA-DR: *13, *15, *52b, *51 a, HLA-DQ: *06, HLA-DP: *04*19 |
| BD0044 | F | Not available |
| BD0014 | F | Not available |
| BD0025 | F | HLA-A: *02, *29, HLA-B: *07, *57, HLA-C: *06, *07, HLA-DR: *01 , *07, *53a, HLA-DQ: *03, *05, HLA-DP: *03, *13 |
| BD0038 | F | HLA-A: *26, *33, HLA-B: *40*58, HLA-C: *03, HLA-DR: *09*11, HLA-DQ: *03, HLA-DP: *04*05 |
| BD0016 | M | HLA-A: *01, *02, HLA-B: *08, *44, HLA-C: *05, *07, HLA-DR: *03, *15, *51a, *52a, HLA-DQ: *02, *06, HLA-DP: *01, *04 |
| BD0007 | F | HLA-A: *01, *32, HLA-B: *08, *15, HLA-C: *07, HLA-DR: *03, *13, *51a, *51c, HLA-DQ: *02, *06, HLA-DP: *04, *13 |

B. Cancer Patients

| ID | LG6 | LG8 | LG9 | LG10 | LG12 |
|---|---|---|---|---|---|
| Age | 72 | 71 | 79 | 67 | 71 |
| Sex | Female | Male | Male | Male | Female |
| Smoking status | Ex-smoker | Ex-smoker | Ex-smoker | Smoker | Ex-smoker |
| HLA type | N/A | N/A | N/A | N/A | N/A |
| Indication/ Treatment | Adenocarcinoma/ currently none, previous chemotherapy and checkpoint inhibitors | Adenocarcinoma/ Tyrosine Kinase inhibitor and Steroid | Adeno carcinoma/ Chemotherapy | Adenocarcinoma/ Checkpoint Inhibitor | SCLC/ Chemotherapy |

| ID | LG19 | OV19 | OV21 | OV22 | BR7 |
|---|---|---|---|---|---|
| Age | 65 | 60-70 | 72 | 76 | 51 |
| Sex | Male | Female | Female | Female | Female |
| Smoking status | Ex-smoker | N/A | N/A | N/A | N/A |
| HLA type | HLA A: A*01 *03 HLA B: B*07, *08 HLA C: C*07 HLA DR: *04*15, *51a, *53a HLA DQ: *03 *06 HLA-DP: *02, *04 | N/A | HLA A: A*0201 HLA B: B*14, *15 HLAC: C*03, *08 HLA DR: *03, *52a, *52b HLA DQ: *02 HLA-DP: *01,*04 | HLA A: A*01 *03 HLA B: B*18, *44 HLA C:C*05, *12 HLA DR: *04, *15, *53a, *51a HLA DQ: *03, *06 HLA-DP: *04, *05 | HLA A: A*11 ,*25 HLA B: B*18, *38 HLA C: CM2 HLA DR: *11, *15,*52b, *51 a HLA DQ: *03, *06 HLA-DP: *04 |

TABLE 6-continued

| Indication/Treatment | | | | |
|---|---|---|---|---|
| Patient with metastatic adenocarcinoma of the lung (liver and lymph node involvement) who has PDL1 staining of 95% of the tumour cells, EGFR mutation and ALK rearrangement negative. The patient was bled prior to the 6th cycle of first line pembrolizumab. Last CT scan 2 months prior showed evidence of disease response | Stage 3C low grade serous ovarian adenocarcinoma. BRCA negative. | Patient with stage 3C high grade papillary serous ovarian carcinoma, BRCA-ve who finished 6 cycles of carboplatin and caelyx on the 14th of March 2019 and had partial response to treatment on CT scan | Patient with stage 4 primary peritoneal adenocarcinoma, who was treatment naïve | Patient with triple negative metastatic breast cancer. Finished Pembrolizumab treatment Apr. 2018. Previous capecitabine and carboplatin. Bled prior to starting Eribulin |

Example 5. To Determine the α and β Chain Pairing of TCRs Recognising Peptides Containing Homocitrulline The CD4 T cells that proliferated (CFSE Low) in response to ALDOA 74-93 Hcit were analysed for their TCR expression in comparison to the non proliferating cells (CFSE High). Examination of TCR clonality of the responding CD4 T cells revealed a bias of TCR Vβ and Vα sequences among CD4+proliferating cells from donor BD00016 ALDOA 74 Hcit (FIG. 27a-d). These responses appear oligoclonal with a couple of dominant TCRVβ and TCRVα chains compared to the non-proliferating CD4s from the same cultures thus suggesting a focussed TCR repertoire.

To identify the correct pairing of the TCRVβ and TCRVα chains, single proliferating cells were sorted into 96 individual wells and TCRα and TCRB chains were sequenced using iPair™ technology. 76/92 wells contained both TCRVβ and TCRVα chains, 89 wells contained sequences identified from bulk analysis. Out of these 38/89 wells contained the TRB chain and 11/89 wells the TRA chain only. 40/89 wells contained both TRA and TRB chains (Table 7). Remaining wells with paired chains contain either a TRA or TRB or both sequence/s of high bulk rank >30 with a frequency of less than <10%.

TABLE 7 iPair™ sequencing and analysis of the TCRα and β chains ALDOA 74 Hcit

| FREQUENCY (40 WELLS) | WELLS | CDR1 Peptide | CDR2 Peptide | CDR3 Peptide | V Gene | D Gene | JGene | C Gene | Read Count | Bulk Rank | Unique/shared | SEQ ID | TCR |
|---|---|---|---|---|---|---|---|---|---|---|---|---|---|
| 8 | B11/D02/ G10/B801/ DE12/DE09/DF06/ DH01 | ENHRY (SEQ ID NO: 85) TISGTDY (SEQ ID NO: 88) | SYGVKD (SEQ ID NO: 86) GLTSN (SEQ ID NO: 89) | AISERRDQETQY (SEQ ID NO: 87) ILRDVYDYKLS (SEQ ID NO: 90) | hTR8V10-3 hTRAV26-2 | * * | hTR8J2-5 hTRAJ20 | hTRBC hTRBC | 9659 4355 | 1 1 | S S | 3 4 | 9 |
| 10 | C04/E02/ F02/H98/ H11/DB10/ DB12/ DE02/ DE03/DF08 | DFQATT (SEQ ID NO: 91) VTNFRS (SEQ ID NO: 94) | SNEGSKA (SEQ ID NO: 92) LTSSGIE (SEQ ID NO: 95) | SAPIHTDTQY (SEQ ID NO: 93) AVHPAGNMLT (SEQ ID NO: 96) | hTR8V20-1 hTRAV36/DV7 | * * | hTR8J2-3 hTRAJ39 | hTBDC hTRBC | 1503 12749 | 5 3 | S S | 15 16 | 10 |
| 3 | G08/DF04/ DG06 | SGHDY (SEQ ID NO: 97) SSVSVY (SEQ ID NO: 100) | FNNNVP (SEQ ID NO: 98) YLSGST LV (SEQ ID NO: 101) | ASRGGLAS NEQF (SEQ ID NO: 99) AVSEGGGSYIPT (SEQ ID NO: 102) | hTR8V12-4 hTRAV8-6 | hTR8D2 * | hTRBJ2-1 hTRAJ6 | hTRBC hTRAC | 404 15860 | 4 2 | S S | 17 18 | 11 |
| 5 | C02/DA04/ DC07/ DE01/ DH10 | LNHDA (SEQ ID NO: 103) DSASNY (SEQ ID NO: 106) | SQIVND (SEQ ID NO: 104) IRSNVGE (SEQ ID NO: 107) | ASSLGTFYEQY (SEQ ID NO: 105) AASGNTNA GKST (SEQ ID NO: 108) | hTR8V19 hTRAV13-1 | hTR8D1 * | hTR8J2-7 hTRAJ27 | hTRBC hTRAC | 900 5387 | 3 7 | S S | 19 20 | 12 20 |

TABLE 7-continued iPair™ sequencing and analysis of the TCRα and β chains ALDOA 74 Hcit

| FREQUENCY (40 WELLS) | WELLS | CDR1 Peptide | CDR2 Peptide | CDR3 Peptide | V Gene | D Gene | J Gene | C Gene | Read Count | Bulk Rank | Unique/shared | SEQ ID | TCR |
|---|---|---|---|---|---|---|---|---|---|---|---|---|---|
| 7 | C03/E05/ E08/F03/ F08/ DF10/ DG07 | SGHRS (SEQ ID NO: 110) TISGTDV (SEQ ID NO: 88) | YFSETQ (SEQ ID NO: 109) GLTSN (SEQ ID NO: 89) | ASSLGVMVVST DTQV (SEQ ID NO: 111) ILRDRVSNF GNEKLT (SEQ ID NO: 112) | hTRBVS-1 hTRAV26-2 | * * | hTRBJ2-3 hTRAJ4B | hTRBC hTRAC | 1244 11109 | 12 6 | U S | 21 22 | 13 |
| 1 | A06 | SGHAT (SEQ ID NO: 113) VSGNPY (SEQ ID NO: 116) | FQNNGV (SEQ ID NO: 114) YITGDNLV (SEQ ID NO: 117) | ASSPTQGASYE QY (SEQ ID NO: 115) AVRDAGYSTLT (SEQ ID NO: 118) | hTRBV11-2 hTRAV3 | hTRBD1 * | hTRBJ2-7 hTRAJ11 | hTRBC hTRAC | 4927 3557 | 2 10 | S S | 23 24 | 14 |
| 1 | DC02 | ENHRY (SEQ ID NO: 85) DSASNY (SEQ ID NO: 106) | SYGVKD (SEQ ID NO: 86) IRSNVGE (SEQ ID NO: 107) | AISERRDQETQY (SEQ ID NO: 87) AASGNT-NAGKST (SEQ ID NO: 108) | hTRBV10-3 hTRAV13-1 | * * | hTRBJ2-S hTRAJ27 | hTRBC hTRAC | 10415 52 | 1 7 | S S | 3 20 | 15 |
| 1 | G01 | ENHRY (SEQ ID NO: 85) DSASNY (SEQ ID NO: 106) | SYGVKD (SEQ ID NO: 86) IRSNVGE (SEQ ID NO: 107) | AISERRDQETQY (SEQ ID NO: 87) AASIDRDD-KII (SEQ ID NO: 119) | hTRBV10-3 hTRAV13-1 | * * | hTRBJ2-5 hTRAJ30 | hTRBC hTRAC | 1437 9890 | 1 58 | S U | 3 25 | 16 |
| 1 | E06 | MDHEN (SEQ ID NO: 120) VSGLRG (SEQ ID NO: 123) | SYDVKM (SEQ ID NO: 121) LYSAGEE (SEQ ID NO: 124) | ATTQGSYN EQF (SEQ ID NO: 122) AVQAGSYIPT (SEQ ID NO: 125) | hTR3V28 hTRAV20 | hTRBD1 * | hTRBJ2-1 hTRAJG | hTRBC hTRAC | 5226 8047 | 7 8 | S S | 26 27 | 17 |

The full sequences of these TCRs are shown in FIGS. 28-35.

The CD4 T cells that proliferated in response to ALDOA 140-157 Hcit were analysed for their TCR expression in comparison to the non proliferating cells. Examination of TCR clonality of the responding CD4 T cells revealed a bias of TCR Vβ and Vα sequences among CD4+proliferating cells from donor BD00016 ALDOA 140-157 Hcit (FIG. 36a-d). These responses appear oligoclonal with a couple of dominant TCRVβ and TCRVα chains compared to the non-proliferating CD4s from the same cultures thus suggesting a focussed TCR repertoire.

To identify the correct pairing of the TCRVβ and TCRVα chains, single proliferating cells were sorted into 96 individual wells and TCRα and TCRB chains were sequenced using iPair™ technology. 60/75 wells contained both TCRVβ and TCRVα chains, 66 wells contained sequences identified from bulk analysis. Out of these 20/66 wells contained the TRB chain and 12/66 wells the TRA chain only. 34/66 wells contained both TRA and TRB chains (Table 8). Remaining wells with paired chains contain either a TRA or TRB or both sequence/s of high bulk rank >30 with a frequency of less than <10%.

TABLE 8 iPair™ sequencing and analysis of the TCRα and β chains ALDOA 140 Hcit

| FREQUENCY (34 WELLS) | WELLS | CDR1 Peptide | CDR2 Peptide | CDR3 Peptide | V Gene | D Gene | J Gene | C Gene | Read Count | Bulk Rank | Unique/shared | SEQ ID | TCR |
|---|---|---|---|---|---|---|---|---|---|---|---|---|---|
| 3 | G07/DA04/ DE06 | EMHRY (SEQ ID NO: 85) | SYGVKD (SEQ ID NO: 86) | AISERRDQETQV (SEQ ID NO: 87) | hTRBV10-3 hTRAV26-2 | * * | hTRBJ2-5 hTRAJ20 | hTRBC hTRAC | 3159 12015 | 1 6 | S S | 8 4 | 18 |

TABLE 8-continued iPair™ sequencing and analysis of the TCRα and β chains ALDOA 140 Hcit

| FREQUENCY (34 WELLS) | WELLS | CDR1 Peptide | CDR2 Peptide | CDR3 Peptide | V Gene | D Gene | J Gene | C Gene | Read Count | Bulk Rank | Unique/ shared | SEQ ID | TCR |
|---|---|---|---|---|---|---|---|---|---|---|---|---|---|
| | | TISGTDY (SEQ ID NO: 88) | GLTSN (SEQ ID NO: 89) | ILRDVYDVKLS (SEQ ID NO: 90) | | | | | | | | | |
| 9 | B01/B06/ C02/E01/ E04/E11/ H08/DE09/ DG11 | DFQATT (SEQ ID NO: 91) SSVPPY (SEQ ID NO: 127) | SNEGSKA (SEQ ID NO: 92) YTSAATLV (SEQ ID NO: 128) | SARTSGTNTQY (SEQ ID NO: 126) AVSGRNDYKLS (SEQ ID NO: 129) | Htrbv20-3 hTRAV8-4 | hTRBD2 * | hTRBJ2-3 hTRAJ20 | hTRBC hTRAC | 3305 12349 | 2 1 | S | 28 29 | 19 |
| 6 | B03/C01/ C03/DB06/ DC05/DC09 | MNHEY (SEQ ID NO: 130) TISGTDY (SEQ ID NO: 88) | SVGEGT (SEQ ID NO: 131) GLTSN (SEQ ID NO: 89) | ASSRSWTASGVT (SEQ ID NO: 132) ILRDGSGNEKLT (SEQ ID NO: 133) | hTRBV6-3 hTRAV26-2 | hTRBD1 * | hTRBJ1-2 hTRAJ48 | hTRBC HTRAC | 2389 13952 | 3 2 | S S | 30 31 | 20 |
| 2 | B08/E12 | SGHNS (SEQ ID NO: 134) DSASNY (SEQ ID NO: 106) | FNNNVP (SEQ ID NO: 98) IRSNVGE (SEQ ID NO: 107) | ASSVAQLAGKGEQF (SEQ ID NO: 135) AASIDRDDKII (SEQ ID NO: 119) | hTRBV12-3 hTRAV13-1 | hTRBD2 * | hTRBJ2-1 hTRAJ30 | hTRBC hTRAC | 3352 8867 | 5 3 | S S | 32 25 | 21 |
| 3 | A1G/D02/ F09 | SNHLY (SEQ ID NO: 136) DSAIVN (SEQ ID NO: 139) | FYNNEI (SEQ ID NO: 137) IQSSQRE (SEQ ID NO: 140) | ASRRVMGYGVT (SEQ ID NO: 138) ALNSGGSNYKLT (SEQ ID NO: 141) | hTRBV2 hTRAV21 | * * | hTRBJ1-2 hTRAJ53 | hTRBC hTRAC | 5484 8520 | 4 11 | S S | 33 34 | 22 |
| 1 | F02 | DFQATT (SEQ ID NO: 91) TISGTDY (SEQ ID NO: 88) | SNEGSKA (SEQ ID NO: 92) GLTSN (SEQ ID NO: 89) | SAGRAGTSGTYEQY (SEQ ID NO: 142) ILRSNPGNEKLT (SEQ ID NO: 143) | hTRBV20-3 hTRAV26-2 | hTRBD2 * | hTRBJ2-7 hTRAJ48 | HTRBC hTRAC | 1569 12730 | 11 4 | U S | 35 36 | 23 |
| 1 | E03 | LNHDA (SEQ ID NO: 103) NYSPAY (SEQ ID NO: 145) | SQIVND (SEQ ID NO: 104) IRENEKE (SEQ ID NO: 146) | ASSGGQFNQPQH (SEQ ID NO: 144) ALGQTGANNLF (SEQ ID NO: 147) | hTRBV10 hTRAV6 | hTRBD1 * | hTRBJ1-5 hTRAJ36 | HTRBC hTRAC | 1303 10507 | 9 8 | S U | 37 38 | 24 |
| 2 | G11/DC02 | KGHSH (SEQ ID NO: 148) TISGNEY (SEQ ID NO: 151) | IQKENI (SEQ ID NO: 149) GLKNN (SEQ ID NO: 152) | ASSPEALANTGELF (SEQ ID NO: 150) IVRVGYNNNDMR (SEQ ID NO: 153) | hTRBV18 hTRAV26-1 | * * | hTRBJ2-2 hTRAJ43 | hTRBC hTRAC | 2473 4309 | 8 7 | S S | 39 40 | 25 |
| 2 | DU/DA12 | KGHDR (SEQ ID NO: 154) TISGTDY (SEQ ID NO: 88) | SFDVKD (SEQ ID NO: 155) GLTSN (SEQ ID NO: 89) | ATSDPSGPPYEQY (SEQ ID NO: 156) ILRAQGGSEKLV (SEQ ID NO: 157) | hTRBV24-1 hTRAV26-2 | hTRBD2 * | hTRBJ2-7 hTRAJ57 | hTRBC hTRAC | 480 13807 | 21 10 | S | 41 42 | 26 |
| 1 | B07 | SNHLV (SEQ ID NO: 136) DSAIYN (SEQ ID NO: 139) | FYNNEI (SEQ ID NO: 137) IQSSQRE (SEQ ID NO: 140) | ASRAGTGIGGVT (SEQ ID NO: 158) AVYSGGSNYRLT (SEQ ID NO: 159) | hTRBV2 hTRAV21 | hTRBD1 * | hTRBJ1-2 hTRAJ53 | hTRBC hTRAC | 2294 12152 | 10 17 | S S | 43 44 | 27 |

The full sequences of these TCRs are shown in FIGS. 37-45.

The CD4 T cells that proliferated in response to vimentin 116-135 Hcit were analysed for their TCR expression in comparison to the non proliferating cells. Examination of TCR clonality of the responding CD4 T cells revealed a bias of TCR Vβ and Vα sequences among CD4+proliferating cells from donor BD00016 ALDOA 140-157 Hcit (FIG. 46a-d). These responses appear oligoclonal with a couple of dominant TCRVβ and TCRVα chains compared to the non-proliferating CD4s from the same cultures thus suggesting a focussed TCR repertoire.

To identify the correct pairing of the TCRVβ and TCRVα chains, single proliferating cells were sorted into 96 individual wells and TCRα and TCRB chains were sequenced using iPair™ technology. 70/80 wells contained both TCRVβ and TCRVα chains, 73 wells contained sequences identified from bulk analysis. Out of these 34/73 wells contained the TRB chain and 9/73 wells the TRA chain only. 30/73 wells contained both TRA and TRB chains (Table 9). Remaining wells with paired chains contain either a TRA or TRB or both sequence/s of high bulk rank >30 with a frequency of less than <10%.

TABLE 9 iPair™ sequencing and analysis of the TCRα and β chains for vimentin 116 Hcit

| FREQUENCY (30 wells) | WELSS | CDR1 Peptide | CDR2 Peptide | CDR3 Peptide | V Gene | D Gene | J Gene | C Gene | Read Count | Bulk Rank | Unique/shared | SEQ ID | TCR |
|---|---|---|---|---|---|---|---|---|---|---|---|---|---|
| 6 | A01/A06/B11/C05/E02/H07 | MDHEN (SEQ ID NO: 120) TSESDYY (SEQ ID NO: 161) | SYDYKM (SEQ ID NO: 121) QEAYKQQN (SEQ ID NO: 162) | ASSLLGSS PLH (SEQ ID NO: 160) AYRSYNQG GKLI (SEQ ID NO: 163) | hTRBV28 hTRAV38-2/DV8 | hTRBD2 * | hTRBJ1-6 HTRAJ23 | hTRBC hTRAC | 236 17129 | 7 1 | S S | 1 2 | 1 |
| 1 | D12 | ENHRY (SEQ ID NO: 85) TISGTDY (SEQ ID NO: 88) | SYGVKD (SEQ ID NO: 86) GLTSN (SEQ ID NO: 89) | AISERRDQ ETQY (SEQ ID NO: 87) ILRDVYDY KLS (SEQ ID NO: 90) | hTRBV10-3 hTRAV26-2 | * * | hTRBJ2-5 HTRAJ20 | hTRBC hTRAC | 545 12336 | 1 2 | S S | 3 4 | 2 |
| 1 | G02 | ENHRY (SEQ ID NO: 85) TISGTDY (SEQ ID NO: 161) | SYGVKD (SEQ ID NO: 86) QEAYKQQN (SEQ ID NO: 162) | AISERRDQ ETQY (SEQ ID NO: 87) AYRSYNQG GKLI (SEQ ID NO: 163) | hTRBV10-3 hTRAV38-2/DV8 | * * | hTRBJ2-5 HTRAJ23 | hTRBC hTRAC | 58 3641 | 1 1 | S S | 3 2 | 3 |
| 2 | D11/F01 | LGHDI (SEQ ID NO: 164) TISGTDY (SEQ ID NO: 88) | YNNKEL (SEQ ID NO: 165) GLTSN (SEQ ID NO: 89) | ASSQEPSI HNEQF (SEQ ID NO: 166) ILKNYGGS QGNLI (SEQ ID NO: 167) | hTRBV3-1 hTRAV26-2 | * * | hTRBJ2-1 HTRAJ42 | hJRbC hTRAC | 822 10799 | 8 3 | S S | 5 6 | 4 |
| 1 | D09 | MNHNY (SEQ ID NO: 168) YSGSPE (SEQ ID NO: 171) | SVGAGI (SEQ ID NO: 169) HISR (SEQ ID NO: 172) | ASSPGQPY GYT (SEQ ID NO: 170) ALSGPSYG QNFV (SEQ ID NO: 173) | hTRBV6-6 hTRAV16 | hTRBD1 | hTRBJ1-2 HTRAJ26 | hTRBC hTRAC | 972 6779 | 4 6 | U S | 7 8 | 5 |
| 1 | C03 | MNHNS (SEQ ID NO: 174) ATGYPS (SEQ ID NO: 177) | SASEGT (SEQ ID NO: 175) ATKADDK (SEQ ID NO: 178) | ASEGLASY NEQF (SEQ ID NO: 176) ALTGGGYQ KVT (SEQ ID NO: 179) | hTRBV6-1 hTRAV9-2 | hTRBD2 * | hTRBJ2-1 HTRAJ13 | hTRBC hTRAC | 6119 3386 | 6 169 | S U | 9 10 | 6 |

TABLE 9-continued iPair™ sequencing and analysis of the TCRα and β chains for vimentin 116 Hcit

| FRE-QUENCY (30 wells) | WELSS | CDR1 Peptide | CDR2 Peptide | CDR3 Peptide | V Gene | D Gene | J Gene | C Gene | Read Count | Bulk Rank | Unique/shared | SEQ ID | TCR |
|---|---|---|---|---|---|---|---|---|---|---|---|---|---|
| 2 | A05/H06 | MNREY (SEQ ID NO: 130) TSINN (SEQ ID NO: 182) | SMNVEV (SEQ ID NO: 180) IRSNERE (SEQ ID NO: 183) | ASSFREGE KLF (SEQ ID NO: 181) ATAMNTGF QKLV (SEQ ID NO: 184) | hTRBV27 hTRAV17 | hTRBD2 * | hTRBJ1-4 hTRAJ8 | hTRBC hTRAC | 516 12085 | 61 8 | U S | 11 12 | 7 |
| 3 | B05/ E01/F10 | LGHNA (SEQ ID NO: 185) NSMFDY (SEQ ID NO: 188) | YNFKEQ (SEQ ID NO: 186) ISISSIKDK (SEQ ID NO: 189) | ASSREGLA GLNEQF (SEQ ID NO: 187) AASGWGDG GATNKLI (SEQ ID NO: 190) | hTRBV4-2 hTRAV29/ DV5 | hTRBD1 * | hTRBJ2-1 HTRAJ32 | hTRBC hTRAC | 10614 2057 | 26 122 | S S | 13 14 | 8 |

The full sequences of these TCRs are shown in FIGS. 47-52.

Example 6. Immunisation with Homocitrulline Peptides Provides Efficient Therapy of the Aggressive B16 Melanoma To determine if the epitopes that stimulate T cell responses are presented on MHC-II within the tumour environment, our homocitrullinated peptides were checked for tumour therapy in B16 tumour models. Mice were implanted with tumour cells on day 1 and then immunised with peptides and CpG/MPLA on days 4, 11 and 18.

HHDII/DR1 (FIG. 19a) or DR4 (FIG. 19b) transgenic mice were challenged with B16F1 HHDII/DR1 or B16F1 DR4 tumours respectively prior to immunisation with vimentin 116-135Hcit peptide and tumour growth and survival were monitored. HHDII/DR1 mice show significantly enhanced survival of 50% compared to control mice (p<0.0001) and wildtype peptide treated mice (p=0.0051). Wild type peptide with CpG/MPLA did not show a significant anti-tumour response. DR4 mice show a similar response with overall survival of 70% in vimentin 116-135Hcit peptide immunised mice which was significantly increased when compared to control mice (p=0.0042).

HHDII/DP4 mice were challenged with B16 HHDII/DP4 tumour cells and then immunised with ALDOA homocitrulline peptides (FIG. 19c). Compared to control mice, the mice treated with either ALDOA 74-93Hcit (90% p<0.0001) or ALDOA 140-157Hcit (60% p=0.0179) showed a significant increase in survival. The combination of both ALDOA homocitrulline peptides also showed significant survival (90% p<0.0001). In HHDII/DR1 mice, immunisation with ALDOA 140Hcit peptide led to a significant increase in survival (p=0.0027) when compared to the control mice (FIG. 19d). ALDOA 74-93Hcit was not tested as it did not induce an immune response in this mouse strain.

HHDII/DR1 mice were implanted with B16HHDII/DR1 tumour cells on day 1 and then immunised with Cyk8 371Hcit, 112hcit or both peptides and CpG/MPLA on days 4, 11 and 18. Significant prevention of tumour growth was seen by both the individual peptide vaccinations (p<0.05) and the combination (p<0.01) (FIG. 20).

This data suggests that ALDOA 74-93Hcit and 140-157Hcit peptides, the vimentin 116-135 Hcit peptide and Cyk8 371-388Hcit and 112-131Hcit are naturally presented and can be targeted for tumour therapy by CD4 or CD8 T cell responses. However, most melanoma tumour cells do not express MHC class II unless stimulated with IFNγ. To mimic the naturally occurring tumour, we engineered B16F1 cells to express HLA-DR4 under control of mouse IFNγ-inducible promoter. The HLA-DR4 expression level can be upregulated in the presence of mouse IFNγ (Brentville et al. 2016; Cook et al. 2018). HLA-DR4 mice were then implanted with this IFNγ-inducible B16 DR4 tumour followed by immunisation with vimentin 116-135Hcit peptide (FIG. 19e). Mice immunised with the vimentin 116-135Hcit peptide showed a significant enhancement of survival (40%) over unimmunised control mice (p=0.0102). This suggests that a vimentin 116-135 Hcit specific response is able to produce enough IFNγ in vivo to upregulate HLA-DR4 expression in the B16 tumour model and promote an anti-tumour effect.

In another similar model, HHDII/DP4 mice were implanted with B16F1 cells expressing HLA-DP4 under control of mouse IFNγ-inducible promoter (B16HHDII/iDP4) on day 1 and then immunised with Cyk8 371Hcit peptide, BiP 526Hcit, Enolase 156Hcit, NPM 266Hcit or Vimentin 86Hcit peptides and CpG/MPLA on days 4, 11 and 18. Significant prevention of tumour growth was seen (p=0.0273, p=0.0027, p=0.0154, p=0.0102 and p=0.0008 respectively) (FIG. 21).

This data suggests that homocitrullinated Cyk8 371, BiP 526, Enolase 156, NPM 266 and Vimentin 86 peptides are naturally presented by tumours and can be targeted by CD4 T cell responses.

Example 7. Tumour Cells do not Express MPO but Neutrophils and MDSCs are a Source of MPO within the Tumour Environment Having demonstrated that peptides containing homocitrulline can induce tumour therapy we next looked to determine the source of carbamylation in the tumour environment. Our in vitro data suggests that cells cultured in the presence of cyanate can undergo intracellular carbamylation. In some inflammatory conditions cyanate levels are increased as a result of the actions of MPO. Therefore, we assessed MPO expression on tumours. Staining of in vitro cultured tumour lines revealed that cells did not express MPO (FIG. 22a). MPO is known to be expressed by some immune cells, therefore tumours grown in vivo were also assessed for MPO expression. Mice were implanted with B16 tumours which were allowed to grow to 10 mm diameter and then extracted, disaggregated and analysed by flow cytometry. MPO expression was absent from the CD45-ve fraction which includes tumour cells but was present on populations of cells expressing CD11b within the CD45+ve fraction (FIG. 22b). Analysis of markers Ly6C and Ly6G reveals a population of CD11b+MPO+ cells that express either Ly6G and lower levels of Ly6C or no Ly6G and higher levels of Ly6C (FIG. 22b). These populations have been characterised in the literature as granulocytic (G-MDSCs) and monocytic (M-MDSCs), respectively (Rose, Misharin, and Perlman 2012; Bronte et al. 2016). The Ly6G+ population could also contain neutrophils as both G-MDSCs and neutrophils express this marker pattern.

To assess if the population of cells within tumour expressing MPO was different from those in the spleen, MPO producing cells were assessed in these tissues. MPO levels were elevate in the tumour when compared to the spleen (FIG. 22c). Staining of splenocytes and tumour infiltrating lymphocytes (TILs) revealed differences in which cell types are producing MPO (FIG. 22d). In the spleen, MPO is predominantly produced by Ly6G+Ly6C$^{low}$ cells (median 65% of MPO+ cells) with only minimally contribution of Ly6G-Ly6Chi cells (median 12% of MPO+ cells). In contrast, in the tumour, MPO is produced predominantly by Ly6G+Ly6C$^{low}$ cells (median 22%) and more Ly6G-Ly6Chi cells (median 36%) with a smaller contribution of the Ly6G Ly6C$^{low}$ cells. This suggests that in the tumour both the G-MDSC-like and M-MDSC-like populations could contribute to carbamylation. To verify if the M-MDSCs were monocyte or macrophage derived they were stained for the macrophage markers CD115 and F4/80 (FIG. 22e). The Ly6G-Ly6C$^{hi}$ cells were negative for the macrophage markers suggesting that they indeed myeloid derived.

Next, we aimed to determine if these cell populations play a role in carbamylation in the tumour microenvironment and are therefore necessary for the anti-tumour effect. HHDII/DP4 mice were implanted with tumour and then immunised with ALDOA homocitrulline peptides. Mice where then either untreated or treated with Ly6G or Ly6C depletion antibodies to remove either the neutrophils/G-MDSCs or monocytes/M-MDSCs, respectively Peptide vaccination was associated with 100% survival whereas peptide and Ly6G+antibody was associated with a slight but significant reduction in the anti-tumour effect (80% survival, p=0.04) (FIG. 23a). However, the combination of vaccination and Ly6G antibody was still significantly better than antibody alone (0% survival, p=0.0017). This suggests that the Ly6G+ population has a small role in the anti-tumour effect.

Next, antibodies were used to deplete the Ly6C+ population (FIG. 23b). Ly6C depletion alone increased survival when compared to control (20% survival, p=0.0012). For this study vaccination alone gave 80% survival (p<0.0001). However, the combination of peptide vaccination and Ly6C antibody significantly reduced the survival seen with vaccine alone (survival 40%, p=0.0480). Survival in the group given vaccine and antibody was comparable with survival seen with the Ly6C antibody treatment alone. Staining of tumours after Ly6C antibody treatment shows a decrease in the level of MPO expressing CD45+ cells (FIG. 23c). Together these results indicate a role for Ly6C+ cells in tumours as the source of MPO which in turn leads to carbamylation of proteins in tumours. The results may also suggest that the Ly6C+ population plays a role in promoting tumour growth given that depletion of these cells increases survival.

To provide further evidence to support the ability of MDSCs to mediate carbamylation MDSCs were generated in vitro from bone marrow derived cells in the presence of GMCSF and IL18. Levels of were measured on G-MDSCs and M-MDSCs by flow cytometry staining. In the presence of the media alone or the LPS stimulation both G-MDSCs and M-MDSCs show evidence of MPO production (FIG. 24a). These results indicate a role for MDSCs as a source of MPO which is necessary for carbamylation.

In vitro cultured MDSCs were co incubated with B16 tumour cells to determine if carbamylation can be induced within the tumour cells. B16 tumour cells are known to lack expression of MPO but upon co incubation with MPO expressing MDSCs and the additional of the MPO substrates KSCN and $H_2O_2$ they show increased levels of carbamylation (FIG. 24b). These results indicate that the MPO produced by MDSCs can act to carbamylate proteins within tumour cells Example 8. Tumour Therapy is Mainly Mediated by the Direct Action of CD4 Cells Upon Tumour Cells Presenting Peptide on MHC-II MDSCs appear to be important for carbamylation in the tumour environment, therefore it is possible that vaccine induce CD4 cells do not directly interact with tumour cells. We next aimed to determine whether tumours cells need to present MHC-II in order for immunisation with carbamylated peptides to have an effect on survival. HLA-DR4 transgenic mice were implanted with tumour cells that were not able to express HLA-DR4 (FIG. 25a). In this model, mice immunised with vimentin 116-135 Hcit peptide showed a survival rate of 20%, which is lower than seen against B16F1 DR4 cells, but was still a significant increase over the control (p=0.0010). This suggests that the vimentin 116-135 Hcit response has an indirect effect upon the tumours in the HLA-DR4 model possibly through the recognition of tumour infiltrating APCs and secretion of proinflammatory cytokines. However, in HHDII/DR1 mice implanted with B16F1 HHDII cells that cannot express DR1, immunisation with vimentin 116-135Hcit peptide provided no survival advantage over the control mice (FIG. 25b). Therefore, direct recognition of tumour cells through MHC-II seems to have a major role in the anti-tumour effect, as tumour therapy is dramatically enhanced in models where the appropriate MHC class II molecule is expressed on the tumour. This is also true in the ALDOA immunised mice. The anti-tumour effect of the carbamylated ALDOA peptides was completely lost in a model where tumour cells could not express HLA-DP4 (FIG. 25c). Therefore, these studies provide evidence for the presentation of the carbamylated peptides by tumour cells on MHC class II molecules and the direct recognition of these by the infiltrating CD4 T cells.

To provide further evidence for the role of CD4 T cell responses in tumour therapy HHDII/DP4 mice were implanted with B16HHDII/iDP4 tumour cells on day 1 and then immunised with peptides and CpG/MPLA on days 4, 8 and 11. Concurrent with peptide immunisation mice were also treated with CD4 or CD8 depleting antibody and tumour growth monitored. Mice immunised with the aldolase Hcit peptides showed 70% tumour free survival (p<0.0001) compared to 10% survival in control unimmunised mice (FIG. 26). Immunisation with the aldolase wt peptides showed no difference in tumour survival compared to control mice indicating that the tumour therapy response is Hcit specific. Depletion of CD8 T cells had no effect upon the tumour therapy mediated by the aldolase Hcit peptides. However, depletion of CD4 T cells caused a significant loss of tumour therapy (p=0.0124) providing evidence for an essential role of the CD4 T cell response in the tumour therapy mediated by the aldolase Hcit peptides. Therefore, this study provides further evidence for the presentation of the carbamylated peptides by tumour and the direct role of CD4 T cells in tumour therapy. To show whether cyanate/isocyanic acid can cross cell membranes B16F1 melanoma cell line was cultured in vitro in the presence or absence of potassium cyanate which is in dynamic equilibrium with isocyanic acid. As a positive control lysates were also produced from in vitro cultured B16F1 cells and then treated with or without KCNO. Carbamylation was significantly increased in both the whole cell and cell lysates after incubation with KCNO (FIG. 9a). This shows that proteins from whole tumour cells can undergo carbamylation, implying that cyanate/isocyanic acid can cross the cell membrane to induce intracellular carbamylation.

B16DP4 tumours were also lysed and analysed by mass spectroscopy for carbamylation of HSP60. K191, K202, K205, K218, K222, K359, K481 and K58 were all carbamylated.

Example 9. Homocitrulline Peptides Bind to HLA-DP4

A known hepB HLA-DP4 binding peptide and 3 peptides which do not bind to HLA-DP4 were biotinylated and incubated with the HLA-DP4 preparation (FIG. 53a). Biotinylated Hep B bound strongly (OD 0.850), in contrast the negative peptides showed no significant binding over background.

To ensure that the biotinylation of Hep B had not interfered with its binding, HLA-DP4 was incubated with equal amounts of biotinylated and unlabelled Hep B peptide. Unlabelled peptide competed equally reducing binding by 47% (FIG. 53b).

The biotinylated HepB peptide was then incubated with a 5 fold excess of the unlabelled homocitrulline peptides. All peptides inhibited the binding of biotinylated Hep B to HLA-DP4 but to varying levels (FIG. 53c-e). Aldolase A 74-93Hcit, Aldolase A 140-157 Hcit, Aldolase A 217-235 Hcit, Aldolase A 238-256 Hcit, Cyk8 101-120 Hcit, Cyk8 112-131 Hcit, Cyk8 182-202 Hcit, Cyk8 371-388 Hcit and Cyk8 281-399 Hcit all showed>than 60% inhibition (Table 10). These results suggest that TCRs that recognise HLA-DP4 complexed with any of these peptides would be useful for tumour therapy. All of the Hcit peptides showed strong inhibition of biotinylated Hep B to HLA-DP4 than the wild type peptides with the exception of vimetin 116 which also failed to induce a T cell response in HLA-DP4 transgenic mice.

TABLE 10

Competitive binding of homocitrulline containing peptides with Hep B viral peptide to HLA-DP4

| Competition | % inhibition |
| --- | --- |
| Biotin Hep-B | |
| Biotin Hep-B + HepB | 47 |
| Biotin Hep-B + Aldolase A 74-93 Hcit | 69 |
| Biotin Hep-B + Aldolase A 74-93 WT | 27 |
| Biotin Hep-B + Aldolase A 140-157 Hcit | 76 |
| Biotin Hep-B + Aldolase A 140-157 WT | 29 |
| Biotin Hep-B + Aldolase A 217-235 Hcit | 84 |
| Biotin Hep-B + Aldolase A 238-256 Hcit | 73 |
| Biotin Hep-B + Aldolase A 289-307 Hcit | 45 |
| Biotin Hep-B + Cyk8 101-120 Hcit | 71 |
| Biotin Hep-B + Cyk8 112-131 Hcit | 64 |
| Biotin Hep-B + Cyk8 182-202 Hcit | 61 |
| Biotin Hep-B + Cyk8 371-388 Hcit | 72 |
| Biotin Hep-B + Cyk8 281-399 Hcit | 60 |
| Biotin Hep-B + Vim 116-135 Hcit | 44 |
| Biotin Hep-B + Vim 116-135 WT | 48 |

REFERENCES

Alland, C., D. Moreews, D. Boens, M. Carpentier, S. Chiusa, M. Lonquety, N. Renault, Y. Wong, H. Cantalloube, J. Chomilier, J. Hochez, J Pothier, B.O. Villoutreix, J.F. Zagury, and P. Tuffery. 2005. 'RPBS: a web resource for structural bioinformatics', *Nucleic Acids Res.*, 33: W44-9.

Altschul, S. F., W. Gish, W. Miller, E. W. Myers, and D. J. Lipman. 1990. 'Basic local alignment search tool', *J Mol Biol*, 215:403-10.

Altschul, S. F., T. L. Madden, A. A. Schaffer, J. Zhang, Z. Zhang, W. Miller, and D. J. Lipman. 1997. 'Gapped BLAST and PSI-BLAST: a new generation of protein database search programs', *Nucleic Acids Res*, 25:3389-402.

Andreatta, M., V. I. Jurtz, T. Kaever, A. Sette, B. Peters, and M. Nielsen. 2017. 'Machine learning reveals a non-canonical mode of peptide binding to MHC class II molecules', *Immunology*, 152:255-64.

Andreatta, M., C. Schafer-Nielsen, O. Lund, S. Buus, and M. Nielsen. 2011. 'NNAlign: a web-based prediction method allowing non-expert end-user discovery of sequence motifs in quantitative peptide data', *PLOS One*, 6: e26781.

Arap, M. A., J. Lahdenranta, P. J. Mintz, A. Hajitou, A. S. Sarkis, W. Arap, and R. Pasqualini. 2004. 'Cell surface expression of the stress response chaperone GRP78 enables tumor targeting by circulating ligands', *Cancer Cell*, 6:275-84.

Arnold, P. Y., N. L. La Gruta, T. Miller, K. M. Vignali, P. S. Adams, D. L. Woodland, and D. A. Vignali. 2002. 'The majority of immunogenic epitopes generate CD4+ T cells that are dependent on MHC class II-bound peptide-flanking residues', *J Immunol,* 169:739-49.

Barra, C., B. Alvarez, S. Paul, A. Sette, B. Peters, M. Andreatta, S. Buus, and M. Nielsen. 2018. 'Footprints of antigen processing boost MHC class II natural ligand predictions', *Genome Med,* 10:84.

Benfeitas, R., M. Uhlen, J. Nielsen, and A. Mardinoglu. 2017. 'New Challenges to Study Heterogeneity in Cancer Redox Metabolism', *Front Cell Dev Biol,* 5:65.

Blass, S., A. Union, J. Raymackers, F. Schumann, U. Ungethum, S. Muller-Steinbach, F. De Keyser, J. M. Engel, and G. R. Burmester. 2001. 'The stress protein BiP is overexpressed and is a major B and T cell target in rheumatoid arthritis', *Arthritis Rheum,* 44:761-71.

Blobel, Gerd A., Roland Moll, Werner W. Franke, and Ingolf Vogt-Moykopf. 1984. 'Cytokeratins in normal lung and lung carcinomas', *Virchows Archiv B,* 45:407-29.

Bobisse, S., R. Genolet, A. *Roberti,* J. L. Tanyi, J. Racle, B. J. Stevenson, C. Iseli, A. Michel, M. A. Le Bitoux, P. Guillaume, J. Schmidt, V. Bianchi, D. Dangaj, C. Fenwick, L. Derre, I. Xenarios, O. Michielin, P. Romero, D. S. Monos, V. Zoete, D. Gfeller, L. E. Kandalaft, G. Coukos, and A. Harari. 2018. 'Sensitive and frequent identification of high avidity neo-epitope specific CD8 (+) T cells in immunotherapy-naive ovarian cancer', *Nat Commun,* 9:1092.

Bodanzsky, Bodanzsky &. 1984. *The practice of peptide synthesis* (Springer Verlag: New York).

Boulter, J. M., M. Glick, P. T. Todorov, E. Baston, M. Sami, P. Rizkallah, and B. K. Jakobsen.

2003. 'Stable, soluble T-cell receptor molecules for crystallization and therapeutics', *Protein Eng,* 16:707-11.

Box, J. K., N. Paquet, M. N. Adams, D. Boucher, E. Bolderson, K. J. O'Byrne, and D. J. Richard. 2016. 'Nucleophosmin: from structure and function to disease development', *BMC Mol Biol,* 17:19.

Brentville, V. A., R. L. Metheringham, B. Gunn, P. Symonds, I. Daniels, M. Gijon, K. Cook, W. Xue, and L. G. Durrant. 2016. 'Citrullinated Vimentin Presented on MHC-II in Tumor Cells Is a Target for CD4+ T-Cell-Mediated Antitumor Immunity', *Cancer Res,* 76:548-60.

Brentville, V. A., P. Symonds, K. W. Cook, I. Daniels, T. Pitt, M. Gijon, P. Vaghela, W. Xue, S. Shah, R. L. Metheringham, and L. G. Durrant. 2019. 'T cell repertoire to citrullinated self-peptides in healthy humans is not confined to the HLA-DR SE alleles; Targeting of citrullinated self-peptides presented by HLA-DP4 for tumour therapy', *Oncoimmunology,* 8: e1576490.

Bronte, V., S. Brandau, S. H. Chen, M. P. Colombo, A. B. Frey, T. F. Greten, S. Mandruzzato, P. J. Murray, A. Ochoa, S. Ostrand-Rosenberg, P. C. Rodriguez, A. Sica, V. Umansky, R. H. Vonderheide, and D. I. Gabrilovich. 2016. 'Recommendations for myeloid-derived suppressor cell nomenclature and characterization standards', *Nat Commun,* 7:12150.

Brown, J. H., T. S. Jardetzky, J. C. Gorga, L. J. Stern, R. G. Urban, J. L. Strominger, and D. C. Wiley. 1993. 'Three-dimensional structure of the human class II histocompatibility antigen HLA-DR1R1', Nature, 364:33-9.

Burska, A. N., L. Hunt, M. Boissinot, R. Strollo, B. J. Ryan, E. Vital, A. Nissim, P. G. Winyard, P. Emery, and F. Ponchel. 2014. 'Autoantibodies to posttranslational modifications in rheumatoid arthritis', *Mediators Inflamm,* 2014:492873.

Cappello, F., E. Conway de Macario, L. Marasa, G. Zummo, and A. J. Macario. 2008. 'Hsp60 expression, new locations, functions and perspectives for cancer diagnosis and therapy', *Cancer Biol Ther,* 7:801-9.

Cappello, P., B. Tomaino, R. Chiarle, P. Ceruti, A. Novarino, C. Castagnoli, P. Migliorini, G. Perconti, A. Giallongo, M. Milella, V. Monsurro, S. Barbi, A. Scarpa, P. Nistico, M. Giovarelli, and F. Novelli. 2009. 'An integrated humoral and cellular response is elicited in pancreatic cancer by alpha-enolase, a novel pancreatic ductal adenocarcinoma-associated antigen', *Int J Cancer,* 125:639-48.

Carson, R. T., K. M. Vignali, D. L. Woodland, and D. A. Vignali. 1997. 'T cell receptor recognition of MHC class II-bound peptide flanking residues enhances immunogenicity and results in altered TCR V region usage', *Immunity,* 7:387-99.

Castillo-Tong, D. C., D. Pils, G. Heinze, I. Braicu, J. Sehouli, A. Reinthaller, E. Schuster, A.

Wolf, R. Watrowski, R. A. Maki, R. Zeillinger, and W. F. Reynolds. 2014. 'Association of myeloperoxidase with ovarian cancer', *Tumour Biol,* 35:141-8.

Cedervall, J., A. Hamidi, and A. K. Olsson. 2018. 'Platelets, NETs and cancer', *Thromb Res,* 164 Suppl 1: S148-S52.

Chang, X., Y. Zhao, Y. Wang, Y. Chen, and X. Yan. 2013. 'Screening citrullinated proteins in synovial tissues of rheumatoid arthritis using 2-dimensional western blotting', *J Rheumatol,* 40:219-27.

Chen, X., T. T. Yang, Y. Zhou, W. Wang, X. C. Qiu, J. Gao, C. X. Li, H. Long, B. A. Ma, Q. Ma, X. Z. Zhang, L. J. Yang, and Q. Y. Fan. 2014. 'Proteomic profiling of osteosarcoma cells identifies ALDOA and SULT1A3 as negative survival markers of human osteosarcoma', *Mol Carcinog,* 53:138-44.

Chou, Y. H., O. Skalli, and R. D. Goldman. 1997. 'Intermediate filaments and cytoplasmic networking: new connections and more functions', *Curr Opin Cell Biol,* 9:49-53.

Consogno, G., S. Manici, V. Facchinetti, A. Bachi, J. Hammer, B. M. Conti-Fine, C. Rugarli, C. Traversari, and M. P. Protti. 2003. 'Identification of immunodominant regions among promiscuous HLA-DR-restricted CD4+ T-cell epitopes on the tumor antigen MAGE-3', *Blood,* 101:1038-44.

Cook, K., I. Daniels, P. Symonds, T. Pitt, M. Gijon, W. Xue, R. Metheringham, L. Durrant, and V. Brentville. 2018. 'Citrullinated alpha-enolase is an effective target for anti-cancer immunity', Oncoimmunology, 7: e1390642.

Corper, A. L., T. Stratmann, V. Apostolopoulos, C. A. Scott, K. C. Garcia, A. S. Kang, I. A. Wilson, and L. Teyton. 2000. 'A structural framework for deciphering the link between I-Ag7 and autoimmune diabetes', *Science,* 288: 505-11.

Coulombe, P. A., and M. B. Omary. 2002. "Hard' and 'soft' principles defining the structure, function and regulation of keratin intermediate filaments', *Curr Opin Cell Biol,* 14:110-22.

Crooks, G. E., G. Hon, J. M. Chandonia, and S. E. Brenner. 2004. 'WebLogo: a sequence logo generator', *Genome Res,* 14:1188-90.

Dai, L., G. Pan, X. Liu, J. Huang, Z. Jiang, X. Zhu, X. Gan, Q. Xu, and N. Tan. 2018. 'High expression of ALDOA and DDX5 are associated with poor prognosis in human colorectal cancer', *Cancer Manag Res,* 10:1799-806.

Davis, M. M., J. J. Boniface, Z. Reich, D. Lyons, J. Hampl, B. Arden, and Y. Chien. 1998. 'Ligand recognition by alpha beta T cell receptors', *Annu Rev Immunol,* 16:523-44.

Dessen, A., C. M. Lawrence, S. Cupo, D. M. Zaller, and D. C. Wiley. 1997. 'X-ray crystal structure of HLA-DR4

(DRA*0101, DRB1*0401) complexed with a peptide from human collagen II', *Immunity,* 7:473-81.

Dorner, A. J., L. C. Wasley, and R. J. Kaufman. 1992. 'Overexpression of GRP78 mitigates stress induction of glucose regulated proteins and blocks secretion of selective proteins in Chinese hamster ovary cells', *EMBO J,* 11:1563-71.

Droeser, R. A., C. Hirt, S. Eppenberger-Castori, I. Zlobec, C. T. Viehl, D. M. Frey, C. A. Nebiker, R. Rosso, M. Zuber, F. Amicarella, G. Iezzi, G. Sconocchia, M. Heberer, A. Lugli, L. Tornillo, D. Oertli, L. Terracciano, and G. C. Spagnoli. 2013. 'High myeloperoxidase positive cell infiltration in colorectal cancer is an independent favorable prognostic factor', *PLOS One,* 8: e64814.

Du, S., Z. Guan, L. Hao, Y. Song, L. Wang, L. Gong, L. Liu, X. Qi, Z. Hou, and S. Shao. 2014. 'Fructose-bisphosphate aldolase a is a potential metastasis-associated marker of lung squamous cell carcinoma and promotes lung cell tumorigenesis and migration', *PLOS One,* 9: e85804.

Eruslanov, E. B., P. S. Bhojnagarwala, J. G. Quatromoni, T. L. Stephen, A. Ranganathan, C. Deshpande, T. Akimova, A. Vachani, L. Litzky, W. W. Hancock, J. R. Conejo-Garcia, M. Feldman, S. M. Albelda, and S. Singhal. 2014. 'Tumor-associated neutrophils stimulate T cell responses in early-stage human lung cancer', *J Clin Invest,* 124:5466-80.

Falini, B., C. Mecucci, E. Tiacci, M. Alcalay, R. Rosati, L. Pasqualucci, R. La Starza, D. Diverio, E. Colombo, A. Santucci, B. Bigerna, R. Pacini, A. Pucciarini, A. Liso, M. Vignetti, P. Fazi, N. Meani, V. Pettirossi, G. Saglio, F. Mandelli, F. Lo-Coco, P. G. Pelicci, M. F. Martelli, and Gimema Acute Leukemia Working Party. 2005. 'Cytoplasmic nucleophosmin in acute myelogenous leukemia with a normal karyotype', *N Engl J Med,* 352:254-66.

Feng, H., Y. Zeng, L. Whitesell, and E. Katsanis. 2001. 'Stressed apoptotic tumor cells express heat shock proteins and elicit tumor-specific immunity', *Blood,* 97:3505-12.

Franke, W. W., D. L. Schiller, R. Moll, S. Winter, E. Schmid, I. Engelbrecht, H. Denk, R. Krepler, and B. Platzer. 1981. 'Diversity of cytokeratins. Differentiation specific expression of cytokeratin polypeptides in epithelial cells and tissues', *J Mol Biol,* 153:933-59.

Fremont, D. H., W. A. Hendrickson, P. Marrack, and J. Kappler. 1996. 'Structures of an MHC class II molecule with covalently bound single peptides', *Science,* 272: 1001-4.

Fremont, D. H., D. Monnaie, C. A. Nelson, W. A. Hendrickson, and E. R. Unanue. 1998. 'Crystal structure of I-Ak in complex with a dominant epitope of lysozyme', *Immunity,* 8:305-17.

Fu, Q. F., Y. Liu, Y. Fan, S. N. Hua, H. Y. Qu, S. W. Dong, R. L. Li, M. Y. Zhao, Y. Zhen, X. L. Yu, Y. Y. Chen, R. C. Luo, R. Li, L. B. Li, X. J. Deng, W. Y. Fang, Z. Liu, and X. Song. 2015. 'Alpha-enolase promotes cell glycolysis, growth, migration, and invasion in non-small cell lung cancer through FAK-mediated PI3K/AKT pathway', *J Hematol Oncol,* 8:22.

Fuchs, E., and D. W. Cleveland. 1998. 'A structural scaffolding of intermediate filaments in health and disease', *Science,* 279:514-9.

Fukunaga, Y., S. Bandoh, J. Fujita, Y. Yang, Y. Ueda, S. Hojo, K. Dohmoto, Y. Tojo, J. Takahara, and T. Ishida. 2002. 'Expression of cytokeratin 8 in lung cancer cell lines and measurement of serum cytokeratin 8 in lung cancer patients', *Lung Cancer,* 38:31-8.

Gay, M. H., T. Valenta, P. Herr, L. Paratore-Hari, K. Basler, and L. Sommer. 2015. 'Distinct adhesion-independent functions of beta-catenin control stage-specific sensory neurogenesis and proliferation', *BMC Biol,* 13:24.

Gerstner, C., A. Dubnovitsky, C. Sandin, G. Kozhukh, H. Uchtenhagen, E. A. James, J. Ronnelid, A. J. Ytterberg, J. Pieper, E. Reed, C. Tandre, M. Rieck, R. A. Zubarev, L. Ronnblom, T. Sandalova, J. H. Buckner, A. Achour, and V. Malmstrom. 2016. 'Functional and Structural Characterization of a Novel HLA-DRB1*04:01-Restricted alpha-Enolase T Cell Epitope in Rheumatoid Arthritis', *Front Immunol,* 7:494.

Geyer, F. C., M. Lacroix-Triki, K. Savage, M. Arnedos, M. B. Lambros, A. Mackay, R. Natrajan, and J. S. Reis-Filho. 2011. 'beta-Catenin pathway activation in breast cancer is associated with triple-negative phenotype but not with CTNNB1 mutation', *Mod Pathol,* 24:209-31.

Ghosh, P., M. Amaya, E. Mellins, and D. C. Wiley. 1995. 'The structure of an intermediate in class II MHC maturation: CLIP bound to HLA-DR3', *Nature,* 378:457-62.

Godkin, A. J., K. J. Smith, A. Willis, M. V. Tejada-Simon, J. Zhang, T. Elliott, and A. V. Hill. 2001. 'Naturally processed HLA class II peptides reveal highly conserved immunogenic flanking region sequence preferences that reflect antigen processing rather than peptide-MHC interactions', *J Immunol,* 166:6720-7.

Goeb, V., M. Thomas-L'Otellier, R. Daveau, R. Charlionet, P. Fardellone, X. Le Loet, F. Tron, D. Gilbert, and O. Vittecoq. 2009. 'Candidate autoantigens identified by mass spectrometry in early rheumatoid arthritis are chaperones and citrullinated glycolytic enzymes', *Arthritis Res Ther,* 11: R38.

Gonzalez-Gronow, M., M. Cuchacovich, C. Llanos, C. Urzua, G. Gawdi, and S. V. Pizzo. 2006. 'Prostate cancer cell proliferation in vitro is modulated by antibodies against glucose-regulated protein 78 isolated from patient serum', *Cancer Res,* 66:11424-31.

Gonzalez-Gronow, M., M. A. Selim, J. Papalas, and S. V. Pizzo. 2009. 'GRP78: a multifunctional receptor on the cell surface', *Antioxid Redox Signal,* 11:2299-306.

Hagiwara, T., K. Nakashima, H. Hirano, T. Senshu, and M. Yamada. 2002. 'Deimination of arginine residues in nucleophosmin/B23 and histones in HL-60 granulocytes', *Biochem Biophys Res Commun,* 290:979-83.

Hamaguchi, T., N. Iizuka, R. Tsunedomi, Y. Hamamoto, T. Miyamoto, M. Iida, Y. Tokuhisa, K. Sakamoto, M. Takashima, T. Tamesa, and M. Oka. 2008. 'Glycolysis module activated by hypoxia-inducible factor 1alpha is related to the aggressive phenotype of hepatocellular carcinoma', *Int J Oncol,* 33:725-31.

Holmberg Olausson, K., T. Elsir, K. Moazemi Goudarzi, M. Nister, and M. S. Lindstrom. 2015. 'NPM1 histone chaperone is upregulated in glioblastoma to promote cell survival and maintain nucleolar shape', *Sci Rep,* 5:16495.

Holzer, M., K. Zangger, D. El-Gamal, V. Binder, S. Curcic, V. Konya, R. Schuligoi, A. Heinemann, and G. Marsche. 2012. 'Myeloperoxidase-derived chlorinating species induce protein carbamylation through decomposition of thiocyanate and urea: novel pathways generating dysfunctional high-density lipoprotein', *Antioxid Redox Signal,* 17:1043-52.

Huang, Z., Y. Hua, Y. Tian, C. Qin, J. Qian, M. Bao, Y. Liu, S. Wang, Q. Cao, X. Ju, Z. Wang, and M. Gu. 2018. 'High expression of fructose-bisphosphate aldolase A induces progression of renal cell carcinoma', *Oncol Rep,* 39:2996-3006.

Hung, K., R. Hayashi, A. Lafond-Walker, C. Lowenstein, D. Pardoll, and H. Levitsky. 1998. 'The Central Role of CD4+ T Cells in the Antitumor Immune Response', *J. Exp. Med.*, 188:2357-68.

Jaisson, S., C. Pietrement, and P. Gillery. 2011. 'Carbamylation-derived products: bioactive compounds and potential biomarkers in chronic renal failure and atherosclerosis', *Clin Chem*, 57:1499-505.

Jakobsen, C. G., N. Rasmussen, A. V. Laenkholm, and H. J. Ditzel. 2007. 'Phage display derived human monoclonal antibodies isolated by binding to the surface of live primary breast cancer cells recognize GRP78', *Cancer Res*, 67:9507-17.

Jang, B., J. K. Jin, Y. C. Jeon, H. J. Cho, A. Ishigami, K. C. Choi, R. I. Carp, N. Maruyama, Y. S. Kim, and E. K. Choi. 2010. 'Involvement of peptidylarginine deiminase-mediated post-translational citrullination in pathogenesis of sporadic Creutzfeldt-Jakob disease', *Acta Neuropathol*, 119:199-210.

Jang, B., E. Kim, J. K. Choi, J. K. Jin, J. I. Kim, A. Ishigami, N. Maruyama, R. I. Carp, Y. S. Kim, and E. K. Choi. 2008. 'Accumulation of citrullinated proteins by upregulated peptidylarginine deiminase 2 in brains of scrapie-infected mice: a possible role in pathogenesis', *Am J Pathol*, 173:1129-42.

Jiang, Z., Y. Cui, L. Wang, Y. Zhao, S. Yan, and X. Chang. 2013. 'Investigating citrullinated proteins in tumour cell lines', *World J Surg Oncol*, 11:260.

June, C. H., M. V. Maus, G. Plesa, L. A. Johnson, Y. Zhao, B. L. Levine, S. A. Grupp, and D. L. Porter. 2014. 'Engineered T cells for cancer therapy', *Cancer Immunol Immunother*, 63:969-75.

Jurtz, V., S. Paul, M. Andreatta, P. Marcatili, B. Peters, and M. Nielsen. 2017. 'NetMHCpan-4.0: Improved Peptide-MHC Class I Interaction Predictions Integrating Eluted Ligand and Peptide Binding Affinity Data', *J Immunol*, 199:3360-68.

Karlin, S., and S. F. Altschul. 1993. 'Applications and statistics for multiple high-scoring segments in molecular sequences', *Proc Natl Acad Sci USA*, 90:5873-7.

Kim, A., I. Z. Hartman, B. Poore, T. Boronina, R. N. Cole, N. Song, M. T. Ciudad, R. R. Caspi, D. Jaraquemada, and S. Sadegh-Nasseri. 2014. 'Divergent paths for the selection of immunodominant epitopes from distinct antigenic sources', *Nat Commun*, 5:5369.

Kjellin, H., H. Johansson, A. Hoog, J. Lehtio, P. J. Jakobsson, and M. Kjellman. 2014. 'Differentially expressed proteins in malignant and benign adrenocortical tumors', *PLOS One*, 9: e87951.

Kollipara, L., and R. P. Zahedi. 2013. 'Protein carbamylation: in vivo modification or in vitro artefact?', *Proteomics*, 13:941-4.

Lac, P., S. Saunders, E. Tutunea-Fatan, L. Barra, D. A. Bell, and E. Cairns. 2018. 'Immune responses to peptides containing homocitrulline or citrulline in the DR4-transgenic mouse model of rheumatoid arthritis', *J Autoimmun*, 89:75-81.

Latek, R. R., A. Suri, S. J. Petzold, C. A. Nelson, O. Kanagawa, E. R. Unanue, and D. H. Fremont. 2000. 'Structural basis of peptide binding and presentation by the type I diabetes-associated MHC class II molecule of NOD mice', *Immunity*, 12:699-710.

Lee, A. S. 2014. 'Glucose-regulated proteins in cancer: molecular mechanisms and therapeutic potential', *Nat Rev Cancer*, 14:263-76.

Lee, K. H., K. W. Wucherpfennig, and D. C. Wiley. 2001. 'Structure of a human insulin peptide-HLA-DQ8 complex and susceptibility to type 1 diabetes', *Nat Immunol*, 2:501-7.

Leotoing, L., L. Meunier, M. Manin, C. Mauduit, M. Decaussin, G. Verrijdt, F. Claessens, M. Benahmed, G. Veyssiere, L. Morel, and C. Beaudoin. 2008. 'Influence of nucleophosmin/B23 on DNA binding and transcriptional activity of the androgen receptor in prostate cancer cell', *Oncogene*, 27:2858-67.

Lessa, R. C., A. H. Campos, C. E. Freitas, F. R. Silva, L. P. Kowalski, A. L. Carvalho, and A. L. Vettore. 2013. 'Identification of upregulated genes in oral squamous cell carcinomas', *Head Neck*, 35:1475-81.

Lewy, T. G., J. M. Grabowski, and M. E. Bloom. 2017. 'BiP: Master Regulator of the Unfolded Protein Response and Crucial Factor in Flavivirus Biology', *Yale J Biol Med*, 90:291-300.

Li, Y., H. Li, R. Martin, and R. A. Mariuzza. 2000. 'Structural basis for the binding of an immunodominant peptide from myelin basic protein in different registers by two HLA-DR2 proteins', *J Mol Biol*, 304:177-88.

Liddy, N., G. Bossi, K. J. Adams, A. Lissina, T. M. Mahon, N. J. Hassan, J. Gavarret, F. C. Bianchi, N. J. Pumphrey, K. Ladell, E. Gostick, A. K. Sewell, N. M. Lissin, N. E. Harwood, P. E. Molloy, Y. Li, B. J. Cameron, M. Sami, E. E. Baston, P. T. Todorov, S. J. Paston, R. E. Dennis, J. V. Harper, S. M. Dunn, R. Ashfield, A. Johnson, Y. McGrath, G. Plesa, C. H. June, M. Kalos, D. A. Price, A. Vuidepot, D. D. Williams, D. H. Sutton, and B. K. Jakobsen. 2012. 'Monoclonal TCR-redirected tumor cell killing', *Nat Med*, 18:980-7.

Lissin, N. M., N. J. Hassan, and B. K. Jakobsen. 2013. High-*Affinity Monoclonal T-Cell Receptor (mTCR) Fusions* (Wiley Online Library: doi.org/10.1002/9781118354599.ch32).

Liu, C. Y., H. H. Lin, M. J. Tang, and Y. K. Wang. 2015. "Vimentin contributes to epithelial-mesenchymal transition cancer cell mechanics by mediating cytoskeletal organization and focal adhesion maturation', *Oncotarget*, 6:15966-83.

Liu, S., J. Matsuzaki, L. Wei, T. Tsuji, S. Battaglia, Q. Hu, E. Cortes, L. Wong, L. Yan, M. Long, A. Miliotto, N. W. Bateman, S. B. Lele, T. Chodon, R. C. Koya, S. Yao, Q. Zhu, T. P. Conrads, J. Wang, G. L. Maxwell, A. A. Lugade, and K. Odunsi. 2019. 'Efficient identification of neoantigen-specific T-cell responses in advanced human ovarian cancer', *J Immunother Cancer*, 7:156.

Lu, M. C., C. L. Yu, H. C. Yu, H. B. Huang, M. Koo, and N. S. Lai. 2016. 'Anti-citrullinated protein antibodies promote apoptosis of mature human Saos-2 osteoblasts via cell-surface binding to citrullinated heat shock protein 60', *Immunobiology*, 221:76-83.

Lugli, E. B., R. E. Correia, R. Fischer, K. Lundberg, K. R. Bracke, A. B. Montgomery, B. M. Kessler, G. G. Brusselle, and P. J. Venables. 2015. 'Expression of citrulline and homocitrulline residues in the lungs of non-smokers and smokers: implications for autoimmunity in rheumatoid arthritis', *Arthritis Res Ther*, 17:9.

Lundberg, K., A. Kinloch, B. A. Fisher, N. Wegner, R. Wait, P. Charles, T. R. Mikuls, and P.

J. Venables. 2008. 'Antibodies to citrullinated alpha-enolase peptide 1 are specific for rheumatoid arthritis and cross-react with bacterial enolase', *Arthritis Rheum*, 58:3009-19.

Lundkvist, A., A. Reichenbach, C. Betsholtz, P. Carmeliet, H. Wolburg, and M. Pekny. 2004. 'Under stress, the absence of intermediate filaments from Muller cells in the retina has structural and functional consequences', *J Cell Sci,* 117:3481-8.

Luo, B., and A. S. Lee. 2013. 'The critical roles of endoplasmic reticulum chaperones and unfolded protein response in tumorigenesis and anticancer therapies', Oncogene, 32:805-18.

Lv, L. H., Y. L. Wan, Y. Lin, W. Zhang, M. Yang, G. L. Li, H. M. Lin, C. Z. Shang, Y. J. Chen, and J. Min. 2012. 'Anticancer drugs cause release of exosomes with heat shock proteins from human hepatocellular carcinoma cells that elicit effective natural killer cell antitumor responses in vitro', *J Biol Chem,* 287:15874-85.

Makrygiannakis, D., M. Hermansson, A. K. Ulfgren, A. P. Nicholas, A. J. Zendman, A. Eklund, J. Grunewald, C. M. Skold, L. Klareskog, and A. I. Catrina. 2008. 'Smoking increases peptidylarginine deiminase 2 enzyme expression in human lungs and increases citrullination in BAL cells', *Ann Rheum Dis,* 67:1488-92.

Martinez, G., J. A. Gomez, H. Bang, L. Martinez-Gamboa, D. Roggenbuck, G. R. Burmester, B. Torres, D. Prada, and E. Feist. 2016. 'Carbamylated vimentin represents a relevant autoantigen in Latin American (Cuban) rheumatoid arthritis patients', *Rheumatol Int,* 36:781-91.

Miao, C. G., Y. Y. Yang, X. He, X. F. Li, C. Huang, Y. Huang, L. Zhang, X. W. Lv, Y. Jin, and J. Li. 2013. 'Wnt signaling pathway in rheumatoid arthritis, with special emphasis on the different roles in synovial inflammation and bone remodeling', *Cell Signal,* 25:2069-78.

Miles, L. A., C. M. Dahlberg, J. Plescia, J. Felez, K. Kato, and E. F. Plow. 1991. 'Role of cell-surface lysines in plasminogen binding to cells: identification of alphaenolase as a candidate plasminogen receptor', *Biochemistry,* 30:1682-91.

Moll, R., W. W. Franke, D. L. Schiller, B. Geiger, and R. Krepler. 1982. 'The catalog of human cytokeratins: patterns of expression in normal epithelia, tumors and cultured cells', *Cell,* 31:11-24.

Moon, R. T., B. Bowerman, M. Boutros, and N. Perrimon. 2002. 'The promise and perils of Wnt signaling through beta-catenin', *Science,* 296:1644-6.

Mydel, P., Z. Wang, M. Brisslert, A. Hellvard, L. E. Dahlberg, S. L. Hazen, and M. Bokarewa. 2010. 'Carbamylation-dependent activation of T cells: a novel mechanism in the pathogenesis of autoimmune arthritis', *J Immunol,* 184:6882-90.

Myers, E. W., and W. Miller. 1989. 'Approximate matching of regular expressions', *Bull Math Biol,* 51:5-37.

Neron, B., H. Menager, C. Maufrais, N. Joly, J. Maupetit, S. Letort, S. Carrere, P. Tuffery, and C. Letondal. 2009. 'Mobyle: a new full web bioinformatics framework', *Bioinformatics,* 25:3005-11.

Ni, M., Y. Zhang, and A. S. Lee. 2011. 'Beyond the endoplasmic reticulum: atypical GRP78 in cell viability, signalling and therapeutic targeting', *Biochem J,* 434:181-8.

Nozawa, Y., N. Van Belzen, A. C. Van der Made, W. N. Dinjens, and F. T. Bosman. 1996. 'Expression of nucleophosmin/B23 in normal and neoplastic colorectal mucosa', *J Pathol,* 178:48-52.

Oshima, R. G. 2002. 'Apoptosis and keratin intermediate filaments', Cell Death Differ, 9:486-92.

Oshima, R. G., H. Baribault, and C. Caulin. 1996. 'Oncogenic regulation and function of keratins 8 and 18', *Cancer Metastasis Rev,* 15:445-71.

Ospelt, C., H. Bang, E. Feist, G. Camici, S. Keller, J. Detert, A. Kramer, S. Gay, K. Ghannam, and G. R. Burmester.

2017. 'Carbamylation of vimentin is inducible by smoking and represents an independent autoantigen in rheumatoid arthritis', *Ann Rheum Dis,* 76:1176-83.

Otsuki, S., M. Inokuchi, M. Enjoji, T. Ishikawa, Y. Takagi, K. Kato, H. Yamada, K. Kojima, and K. Sugihara. 2011. 'Vimentin expression is associated with decreased survival in gastric cancer', *Oncol Rep,* 25:1235-42.

Owens, D. W., and E. B. Lane. 2003. 'The quest for the function of simple epithelial keratins', *Bioessays,* 25:748-58.

Paramio, J. M., and J. L. Jorcano. 2002. 'Beyond structure: do intermediate filaments modulate cell signalling?', *Bioessays,* 24:836-44.

Pearson, W. R., and D. J. Lipman. 1988. 'Improved tools for biological sequence comparison', *Proc Natl Acad Sci USA,* 85:2444-8.

Peng, Y., X. Li, M. Wu, J. Yang, M. Liu, W. Zhang, B. Xiang, X. Wang, X. Li, G. Li, and S.

Shen. 2012. 'New prognosis biomarkers identified by dynamic proteomic analysis of colorectal cancer', *Mol Biosyst,* 8:3077-88.

Pianta, A., C. Puppin, A. Franzoni, D. Fabbro, C. Di Loreto, S. Bulotta, M. Deganuto, I.

Paron, G. Tell, E. Puxeddu, S. Filetti, D. Russo, and G. Damante. 2010. 'Nucleophosmin is overexpressed in thyroid tumors', *Biochem Biophys Res Commun,* 397:499-504.

Polioudaki, H., S. Agelaki, R. Chiotaki, E. Politaki, D. Mavroudis, A. Matikas, V. Georgoulias, and P. A. Theodoropoulos. 2015. 'Variable expression levels of keratin and vimentin reveal differential EMT status of circulating tumor cells and correlation with clinical characteristics and outcome of patients with metastatic breast cancer', *BMC Cancer,* 15:399.

Principe, M., P. Ceruti, N. Y. Shih, M. S. Chattaragada, S. Rolla, L. Conti, M. Bestagno, L. Zentilin, S. H. Yang, P. Migliorini, P. Cappello, O. Burrone, and F. Novelli. 2015. 'Targeting of surface alpha-enolase inhibits the invasiveness of pancreatic cancer cells', *Oncotarget,* 6:11098-113.

Remington, R P. 1980. *Remington's pharmaceutical sciences* (Mack Pub. Co).

Ritterson Lew, C., and D. R. Tolan. 2012. 'Targeting of several glycolytic enzymes using RNA interference reveals aldolase affects cancer cell proliferation through a non-glycolytic mechanism', *J Biol Chem,* 287:42554-63.

Roberts, J. M., P. R. Veres, A. K. Cochran, C. Warneke, I. R. Burling, R. J. Yokelson, B. Lerner, J. B. Gilman, W. C. Kuster, R. Fall, and J. de Gouw. 2011. 'Isocyanic acid in the atmosphere and its possible link to smoke-related health effects', *Proc Natl Acad Sci USA,* 108:8966-71.

Rose, S., A. Misharin, and H. Perlman. 2012. 'A novel Ly6C/Ly6G-based strategy to analyze the mouse splenic myeloid compartment', *Cytometry* A, 81:343-50.

Saini, J., and P. K. Sharma. 2017. 'Clinical, Prognostic and Therapeutic Significance of Heat Shock Proteins in Cancer', *Curr Drug Targets.*

Scinocca, M., D. A. Bell, M. Racape, R. Joseph, G. Shaw, J. K. McCormick, D. D. Gladman, J. Pope, L. Barra, and E. Cairns. 2014. 'Antihomocitrullinated fibrinogen antibodies are specific to rheumatoid arthritis and frequently bind citrullinated proteins/peptides', *J Rheumatol,* 41:270-9.

Scott, C. A., P. A. Peterson, L. Teyton, and I. A. Wilson. 1998. 'Crystal structures of two I-Ad-peptide complexes reveal that high affinity can be achieved without large anchor residues', Immunity, 8:319-29.

Semenza, G. L., B. H. Jiang, S. W. Leung, R. Passantino, J. P. Concordet, P. Maire, and A. Giallongo. 1996. 'Hypoxia response elements in the aldolase A, enolase 1, and lactate dehydrogenase A gene promoters contain essential binding sites for hypoxia-inducible factor 1', J Biol Chem, 271:32529-37.

Sette, A., L. Adorini, S. M. Colon, S. Buus, and H. M. Grey. 1989. 'Capacity of intact proteins to bind to MHC class II molecules', J Immunol, 143:1265-7.

Shi, J., R. Knevel, P. Suwannalai, M. P. van der Linden, G. M. Janssen, P. A. van Veelen, N. E. Levarht, A. H. van der Helm-van Mil, A. Cerami, T. W. Huizinga, R. E. Toes, and L. A. Trouw. 2011. 'Autoantibodies recognizing carbamylated proteins are present in sera of patients with rheumatoid arthritis and predict joint damage', Proc Natl Acad Sci USA, 108:17372-7.

Shi, J., P. A. van Veelen, M. Mahler, G. M. Janssen, J. W. Drijfhout, T. W. Huizinga, R. E. Toes, and L. A. Trouw. 2014. 'Carbamylation and antibodies against carbamylated proteins in autoimmunity and other pathologies', Autoimmun Rev, 13:225-30.

Shoda, H., K. Fujio, M. Shibuya, T. Okamura, S. Sumitomo, A. Okamoto, T. Sawada, and K. Yamamoto. 2011. 'Detection of autoantibodies to citrullinated BiP in rheumatoid arthritis patients and pro-inflammatory role of citrullinated BiP in collagen-induced arthritis', Arthritis Res Ther, 13: R191.

Smith, K. J., J. Pyrdol, L. Gauthier, D. C. Wiley, and K. W. Wucherpfennig. 1998. 'Crystal structure of HLA-DR2 (DRA*0101, DRB1*1501) complexed with a peptide from human myelin basic protein', J Exp Med, 188:1511-20.

Stern, L. J., J. H. Brown, T. S. Jardetzky, J. C. Gorga, R. G. Urban, J. L. Strominger, and D. C. Wiley. 1994. 'Crystal structure of the human class II MHC protein HLA-DR1 complexed with an influenza virus peptide', Nature, 368: 215-21.

Stewart. 1984. Solid phase peptide synthesis (Illinois Pierce Chemical Company: Rockford).

Stoop, J. N., B. S. Liu, J. Shi, D. T. Jansen, M. Hegen, T. W. Huizinga, L. A. Trouw, and R. E. Toes. 2014. 'Antibodies specific for carbamylated proteins precede the onset of clinical symptoms in mice with collagen induced arthritis', PLOS One, 9: e102163.

Tadokoro, A., N. Kanaji, D. Liu, H. Yokomise, R. Haba, T. Ishii, T. Takagi, N. Watanabe, N. Kita, N. Kadowaki, and S. Bandoh. 2016. 'Vimentin Regulates Invasiveness and Is a Poor Prognostic Marker in Non-small Cell Lung Cancer', Anticancer Res, 36:1545-51.

Tanaka, M., H. Sasaki, I. Kino, T. Sugimura, and M. Terada. 1992. 'Genes preferentially expressed in embryo stomach are predominantly expressed in gastric cancer', Cancer Res, 52:3372-7.

Tanikawa, C., K. Ueda, H. Nakagawa, N. Yoshida, Y. Nakamura, and K. Matsuda. 2009. 'Regulation of protein Citrullination through p53/PADI4 network in DNA damage response', Cancer Res, 69:8761-9.

Thomas, P. A., D. A. Kirschmann, J. R. Cerhan, R. Folberg, E. A. Seftor, T. A. Sellers, and M. J. Hendrix. 1999. 'Association between keratin and vimentin expression, malignant phenotype, and survival in postmenopausal breast cancer patients', Clin Cancer Res, 5:2698-703.

Thomsen, M. C., and M. Nielsen. 2012. 'Seq2Logo: a method for construction and visualization of amino acid binding motifs and sequence profiles including sequence weighting, pseudo counts and two-sided representation of amino acid enrichment and depletion', Nucleic Acids Res, 40: W281-7.

Torelli, A., and C. A. Robotti. 1994. 'ADVANCE and ADAM: two algorithms for the analysis of global similarity between homologous informational sequences', Comput Appl Biosci, 10:3-5.

Tsui, K. H., A. J. Cheng, Pe Chang, T. L. Pan, and B. Y. Yung. 2004. 'Association of nucleophosmin/B23 mRNA expression with clinical outcome in patients with bladder carcinoma', Urology, 64:839-44.

Turunen, S., P. Hannonen, M. K. Koivula, L. Risteli, and J. Risteli. 2015. 'Separate and overlapping specificities in rheumatoid arthritis antibodies binding to citrulline- and homocitrulline-containing peptides related to type I and II collagen telopeptides', Arthritis Res Ther, 17:2.

Turunen, S., J. Huhtakangas, T. Nousiainen, M. Valkealahti, J. Melkko, J. Risteli, and P. Lehenkari. 2016. 'Rheumatoid arthritis antigens homocitrulline and citrulline are generated by local myeloperoxidase and peptidyl arginine deiminases 2, 3 and 4 in rheumatoid nodule and synovial tissue', Arthritis Res Ther, 18:239.

Vaidya, M. M., A. M. Borges, S. A. Pradhan, R. M. Rajpal, and A. N. Bhisey. 1989. 'Altered keratin expression in buccal mucosal squamous cell carcinoma', J Oral Pathol Med, 18:282-6.

Wang, P., J. Sidney, C. Dow, B. Mothe, A. Sette, and B. Peters. 2008. 'A systematic assessment of MHC class II peptide binding predictions and evaluation of a consensus approach', PLOS Comput Biol, 4: e1000048.

Wang, P., J. Sidney, Y. Kim, A. Sette, O. Lund, M. Nielsen, and B. Peters. 2010. 'Peptide binding predictions for HLA DR, DP and DQ molecules', BMC Bioinformatics, 11:568.

Wang, X., P. Chen, J. Cui, C. Yang, and H. Du. 2015. 'Keratin 8 is a novel autoantigen of rheumatoid arthritis', Biochem Biophys Res Commun, 465:665-9.

Wang, Z., S. J. Nicholls, E. R. Rodriguez, O. Kummu, S. Horkko, J. Barnard, W. F. Reynolds, E. J. Topol, J. A. DiDonato, and S. L. Hazen. 2007. 'Protein carbamylation links inflammation, smoking, uremia and atherogenesis', Nat Med, 13:1176-84.

Xue, W., R. L. Metheringham, V. A. Brentville, B. Gunn, P. Symonds, H. Yagita, J. M. Ramage, and L. G. Durrant. 2016. 'SCIB2, an antibody DNA vaccine encoding NY-ESO-1 epitopes, induces potent antitumor immunity which is further enhanced by checkpoint blockade', Oncoimmunology, 5: e1169353.

Yamashita, N., E. Tokunaga, H. Kitao, Y. Hisamatsu, K. Taketani, S. Akiyoshi, S. Okada, S. Aishima, M. Morita, and Y. Maehara. 2013. 'Vimentin as a poor prognostic factor for triple-negative breast cancer', J Cancer Res Clin Oncol, 139:739-46.

Ye, F., Y. Chen, L. Xia, J. Lian, and S. Yang. 2018. 'Aldolase A overexpression is associated with poor prognosis and promotes tumor progression by the epithelial-mesenchymal transition in colon cancer', Biochem Biophys Res Commun, 497:639-45.

Youn, J. I., M. Collazo, I. N. Shalova, S. K. Biswas, and D. I. Gabrilovich. 2012. 'Characterization of the nature of granulocytic myeloid-derived suppressor cells in tumor-bearing mice', J Leukoc Biol, 91:167-81.

Yun, J. P., J. Miao, G. G. Chen, Q. H. Tian, C. Q. Zhang, J. Xiang, J. Fu, and P. B. Lai. 2007. 'Increased expression of nucleophosmin/B23 in hepatocellular carcinoma and correlation with clinicopathological parameters', Br J Cancer, 96:477-84.

Zhang, F., J. D. Lin, X. Y. Zuo, Y. X. Zhuang, C. Q. Hong, G. J. Zhang, X. J. Cui, and Y. K. Cui. 2017. 'Elevated transcriptional levels of aldolase A (ALDOA) associates with cell cycle-related genes in patients with NSCLC and several solid tumors', *BioData Min,* 10:6.

Zhang, L., K. Udaka, H. Mamitsuka, and S. Zhu. 2012. 'Toward more accurate pan-specific MHC-peptide binding prediction: a review of current methods and tools', *Brief Bioinform,* 13:350-64.

Zhang, Y., R. Liu, M. Ni, P. Gill, and A. S. Lee. 2010. 'Cell surface relocalization of the endoplasmic reticulum chaperone and unfolded protein response regulator GRP78/BiP', *J Biol Chem,* 285:15065-75.

Zhao, M., W. Fang, Y. Wang, S. Guo, L. Shu, L. Wang, Y. Chen, Q. Fu, Y. Liu, S. Hua, Y. Fan, Y. Liu, X. Deng, R. Luo, Z. Mei, Q. Jiang, and Z. Liu. 2015. 'Enolase-1 is a therapeutic target in endometrial carcinoma', *Oncotarget,* 6:15610-27.

Zhao, Y., T. Wu, S. Shao, B. Shi, and Y. Zhao. 2016. 'Phenotype, development, and biological function of myeloid-derived suppressor cells', Oncoimmunology, 5: e1004983.

Zhu, Y., M. Shi, H. Chen, J. Gu, J. Zhang, B. Shen, X. Deng, J. Xie, X. Zhan, and C. Peng. 2015. 'NPM1 activates metabolic changes by inhibiting FBP1 while promoting the tumorigenicity of pancreatic cancer cells', *Oncotarget,* 6:21443-51.

SEQUENCE LISTING (1629 sequences)

SEQ ID NO: 1 - protein, 14 aa, Homo sapiens
RLQSIGTENTEENR

SEQ ID NO: 2 - protein, 15 aa, Homo sapiens
  misc_feature (1)..(1): Xaa can be lysine or homocitrulline
  misc_feature (8)..(8): Xaa can be lysine or homocitrulline
  misc_feature (15)..(15): Xaa can be lysine or homocitrulline
XDGADFAXWRRCVLX

SEQ ID NO: 3 - protein, 20 aa, Homo sapiens
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 4 - protein, 21 aa, Homo sapiens
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 5 - protein, 21 aa, Homo sapiens
  misc_feature (8)..(8): Xaa can be lysine or homocitrulline
QIDVDVSXPDLTAALRDVRQQ

SEQ ID NO: 6 - protein, 18 aa, Homo sapiens
  misc_feature (7)..(7): Xaa can be lysine or homocitrulline
  misc_feature (9)..(9): Xaa can be lysine or homocitrulline
EAEEWYXSXFADLSEAAN

SEQ ID NO: 7 - protein, 23 aa, Homo sapiens
  misc_feature (9)..(9): Xaa can be lysine or homocitrulline
  misc_feature (14)..(14): Xaa can be lysine or homocitrulline
LPLVDTHSXRTLLXTVETRDGQV

SEQ ID NO: 8 - protein, 20 aa, Homo sapiens
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 9 - protein, 22 aa, Homo sapiens
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 10 - protein, 14 aa, Homo sapiens
  misc_feature (1)..(1): Xaa can be lysine or homocitrulline
  misc_feature (10)..(10): Xaa can be lysine or homocitrulline
XVRFLEQQNXLLAE

SEQ ID NO: 11 - protein, 18 aa, Homo sapiens
  misc_feature (12)..(12): Xaa can be lysine or homocitrulline
DVRQQYESVAAXNLQEAE

SEQ ID NO: 12 - protein, 20 aa, Homo sapiens
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 13 - protein, 23 aa, Homo sapiens
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 14 - protein, 19 aa, Homo sapiens
  misc_feature (1)..(1): Xaa can be lysine or homocitrulline
  misc_feature (13)..(13): Xaa can be lysine or homocitrulline
XMALDIEIATYRXLLEGEE

SEQ ID NO: 15 - protein, 20 aa, Homo sapiens
  misc_feature (14)..(14): Xaa can be lysine or homocitrulline
IGGVILFHETLYQXADDGRP

SEQ ID NO: 16 - protein, 18 aa, Homo sapiens
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 17 - protein, 19 aa, Homo sapiens
  misc_feature (14)..(14): Xaa can be lysine or homocitrulline
LSDHHIYLEGTLLXPNMVT

SEQ ID NO: 18 - protein, 19 aa, Homo sapiens
  misc_feature (6)..(6): Xaa can be lysine or homocitrulline
HACTQXFSHEEIAMATVTA

SEQ ID NO: 19 - protein, 19 aa, Homo sapiens
  misc_feature (1)..(1): Xaa can be lysine or homocitrulline
  misc_feature (6)..(6): Xaa can be lysine or homocitrulline
XCPLLXPWALTFSYGRALQ

SEQ ID NO: 20 - protein, 19 aa, Homo sapiens
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 21 - protein, 20 aa, Homo sapiens
  misc_feature (8)..(8): Xaa can be lysine or homocitrulline
  misc_feature (20)..(20): Xaa can be lysine or homocitrulline
AAQEEYVXRALANSLACQGX

SEQ ID NO: 22 - protein, 19 aa, Homo sapiens
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 23 - protein, 16 aa, Homo sapiens
  misc_feature (5)..(5): Xaa can be lysine or homocitrulline
  misc_feature (12)..(12): Xaa can be lysine or homocitrulline
YVTEXVLAAVYXALSD

SEQ ID NO: 24 - protein, 9 aa, Homo sapiens
  misc_feature (7)..(7): Xaa can be lysine or homocitrulline
VLAAVYXAL

SEQ ID NO: 25 - protein, 20 aa, Homo sapiens
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRFLEQQNXMLE

SEQ ID NO: 26 - protein, 20 aa, Homo sapiens
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXMLETXWSLLQQQXT

SEQ ID NO: 27 - protein, 9 aa, Homo sapiens
  misc_feature (1)..(1): Xaa can be lysine or homocitrulline
  misc_feature (6)..(6): Xaa can be lysine or homocitrulline
XMLETXWSL

SEQ ID NO: 28 - protein, 21 aa, Homo sapiens
  misc_feature (4)..(4): Xaa can be lysine or homocitrulline
  misc_feature (16)..(17): Xaa can be lysine or homocitrulline
EINXRTEMENEFVLIXXDVDE

SEQ ID NO: 29 - protein, 18 aa, Homo sapiens
  misc_feature (11)..(11): Xaa can be lysine or homocitrulline
LREYQELMNVXLALDIEI

SEQ ID NO: 30 - protein, 19 aa, Homo sapiens
  misc_feature (1)..(1): Xaa can be lysine or homocitrulline
  misc_feature (13)..(13): Xaa can be lysine or homocitrulline
XLALDIEIATYRXLLEGEE

SEQ ID NO: 31 - protein, 21 aa, Homo sapiens
  misc_feature (3)..(3): Xaa can be lysine or homocitrulline
  misc_feature (11)..(11): Xaa can be lysine or homocitrulline
ETXWSLLQQQXTARSNMDNMF

SEQ ID NO: 32 - protein, 20 aa, Homo sapiens
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXSLNNXFASFIDXVRFL

SEQ ID NO: 33 - protein, 19 aa, Homo sapiens
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 34 - protein, 17 aa, Homo sapiens
  misc_feature (2)..(2): Xaa can be lysine or homocitrulline
  misc_feature (11)..(11): Xaa can be lysine or homocitrulline
GXHGDDLRRTXTEISEM

SEQ ID NO: 35 - protein, 18 aa, Homo sapiens
  misc_feature (13)..(13): Xaa can be lysine or homocitrulline
RQLREYQELMNVXLALEI

SEQ ID NO: 36 - protein, 19 aa, Homo sapiens
  misc_feature (6)..(6): Xaa can be lysine or homocitrulline
EIEGLXGQRASLEAAIADA

SEQ ID NO: 37 - protein, 20 aa, Homo sapiens
  misc_feature (9)..(9): Xaa can be lysine or homocitrulline
  misc_feature (14)..(14): Xaa can be lysine or homocitrulline
EQRGELAIXDANAXLSELEA

SEQ ID NO: 38 - protein, 21 aa, Homo sapiens
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 39 - protein, 16 aa, Homo sapiens
  misc_feature (9)..(9): Xaa can be lysine or homocitrulline
  misc_feature (11)..(11): Xaa can be lysine or homocitrulline
EISAMVLTXMXETAEA

SEQ ID NO: 40 - protein, 21 aa, Homo sapiens
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 41 - protein, 21 aa, Homo sapiens
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 42 - protein, 21 aa, Homo sapiens
  misc_feature (11)..(11): Xaa can be lysine or homocitrulline
EDFSETLTRAXFEELNMDLFR

SEQ ID NO: 43 - protein, 19 aa, Homo sapiens
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 44 - protein, 21 aa, Homo sapiens
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 45 - protein, 21 aa, Homo sapiens
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 46 - protein, 18 aa, Homo sapiens
  misc_feature (12)..(12): Xaa can be lysine or homocitrulline
  misc_feature (18)..(18): Xaa can be lysine or homocitrulline
RNELESYAYSLXNQIGDX

SEQ ID NO: 47 - protein, 20 aa, Homo sapiens
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 48 - protein, 17 aa, Homo sapiens
  misc_feature (14)..(14): Xaa can be lysine or homocitrulline
  misc_feature (17)..(17): Xaa can be lysine or homocitrulline
PLRPQNYLFGCELXADX

SEQ ID NO: 49 - protein, 22 aa, Homo sapiens
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 50 - protein, 21 aa, Homo sapiens
  misc_feature (6)..(6): Xaa can be lysine or homocitrulline
  misc_feature (13)..(13): Xaa can be lysine or homocitrulline
EEEDVXLLSISGXRSAPGGGS

SEQ ID NO: 51 - protein, 19 aa, Homo sapiens
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 52 - protein, 20 aa, Homo sapiens
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 53 - protein, 22 aa, Homo sapiens
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 54 - protein, 16 aa, Homo sapiens
  misc_feature (5)..(5): Xaa can be lysine or homocitrulline
MSILXIHAREIFDSRG

SEQ ID NO: 55 - protein, 18 aa, Homo sapiens
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 56 - protein, 22 aa, Homo sapiens
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 57 - protein, 21 aa, Homo sapiens
  misc_feature (7)..(7): Xaa can be lysine or homocitrulline
GSHAGNXLAMQEFMILPVGAA

SEQ ID NO: 58 - protein, 19 aa, Homo sapiens
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 59 - protein, 19 aa, Homo sapiens
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 60 - protein, 20 aa, Homo sapiens
  misc_feature (12)..(12): Xaa can be lysine or homocitrulline
  misc_feature (18)..(18): Xaa can be lysine or homocitrulline
DVAASEFFRSGXYDLDFXSP

SEQ ID NO: 61 - protein, 19 aa, Homo sapiens
  misc_feature (9)..(9): Xaa can be lysine or homocitrulline
  misc_feature (13)..(13): Xaa can be lysine or homocitrulline
PDQLADLYXSFIXDYPVVS

SEQ ID NO: 62 - protein, 17 aa, Homo sapiens
  misc_feature (6)..(6): Xaa can be lysine or homocitrulline
WGAWQXFTASAGIQVVG

SEQ ID NO: 63 - protein, 19 aa, Homo sapiens
  misc_feature (2)..(2): Xaa can be lysine or homocitrulline
  misc_feature (10)..(10): Xaa can be lysine or homocitrulline
NXSCNCLLLXVNQIGSVTE

SEQ ID NO: 64 - protein, 20 aa, Homo sapiens
  misc_feature (7)..(7): Xaa can be lysine or homocitrulline
RSERLAXYNQLLRIEEELGS

SEQ ID NO: 65 - protein, 17 aa, Homo sapiens
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRNFRNPLAX

SEQ ID NO: 66 - protein, 18 aa, Homo sapiens
  misc_feature (7)..(7): Xaa can be lysine or homocitrulline
EPSQMLXHAVVNLINYQD

SEQ ID NO: 67 - protein, 21 aa, Homo sapiens
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 68 - protein, 18 aa, Homo sapiens
  misc_feature (13)..(13): Xaa can be lysine or homocitrulline
TLHNLLLHQEGAXMAVRL

SEQ ID NO: 69 - protein, 20 aa, Homo sapiens
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 70 - protein, 20 aa, Homo sapiens
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 71 - protein, 18 aa, Homo sapiens
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 72 - protein, 19 aa, Homo sapiens
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 73 - protein, 18 aa, Homo sapiens
  misc_feature (8)..(8): Xaa can be lysine or homocitrulline
YGLPVVVXLLHPPSHWPL

SEQ ID NO: 74 - protein, 20 aa, Homo sapiens
  misc_feature (6)..(6): Xaa can be lysine or homocitrulline
HWPLIXATVGLIRNLALCPA

SEQ ID NO: 75 - protein, 19 aa, Homo sapiens
  misc_feature (19)..(19): Xaa can be lysine or homocitrulline
IENIQRVAAGVLCELAQDX

SEQ ID NO: 76 - protein, 18 aa, Homo sapiens
  misc_feature (17)..(17): Xaa can be lysine or homocitrulline
GVATYAAAVLFRMSEDXP

SEQ ID NO: 77 - protein, 20 aa, Homo sapiens
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 78 - protein, 20 aa, Homo sapiens
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 79 - protein, 20 aa, Homo sapiens
  misc_feature (13)..(13): Xaa can be lysine or homocitrulline
GEALSTLVLNRLXVGLQVVA

SEQ ID NO: 80 - protein, 18 aa, Homo sapiens
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 81 - protein, 20 aa, Homo sapiens
  misc_feature (8)..(8): Xaa can be lysine or homocitrulline
GIIDPTVXVRTALLDAAGVA

SEQ ID NO: 82 - protein, 8 aa, Homo sapiens
  misc_feature (1)..(1): Xaa can be lysine or homocitrulline
  misc_feature (6)..(6): Xaa can be lysine or homocitrulline
XMLETXWS

SEQ ID NO: 83 - protein, 10 aa, Homo sapiens
  misc_feature (7)..(8): Xaa can be lysine or homocitrulline
VLAAVYXXAL

SEQ ID NO: 84 - protein, 10 aa, Homo sapiens
  misc_feature (1)..(1): Xaa can be lysine or homocitrulline
  misc_feature (6)..(7): Xaa can be lysine or homocitrulline
XMLETXXWSL

SEQ ID NO: 85 - protein, 5 aa, Homo sapiens
ENHRY

SEQ ID NO: 86 - protein, 6 aa, Homo sapiens
  misc_feature (5)..(5): Xaa can be lysine or homocitrulline
SYGVXD

SEQ ID NO: 87 - protein, 12 aa, Homo sapiens
AISERRDQETQY

SEQ ID NO: 88 - protein, 7 aa, Homo sapiens
TISGTDY

SEQ ID NO: 89 - protein, 5 aa, Homo sapiens
GLTSN

SEQ ID NO: 90 - protein, 11 aa, Homo sapiens
  misc_feature (9)..(9): Xaa can be lysine or homocitrulline
ILRDVYDYXLS

SEQ ID NO: 91 - protein, 6 aa, Homo sapiens
DFQATT

SEQ ID NO: 92 - protein, 7 aa, Homo sapiens
  misc_feature (6)..(6): Xaa can be lysine or homocitrulline
SNEGSXA

SEQ ID NO: 93 - protein, 10 aa, Homo sapiens
SAPIHTDTQY

SEQ ID NO: 94 - protein, 6 aa, Homo sapiens
VTNFRS

SEQ ID NO: 95 - protein, 7 aa, Homo sapiens
LTSSGIE

SEQ ID NO: 96 - protein, 10 aa, Homo sapiens
AVHDAGNMLT

SEQ ID NO: 97 - protein, 5 aa, Homo sapiens
SGHDY

SEQ ID NO: 98 - protein, 6 aa, Homo sapiens
FNNNVP

SEQ ID NO: 99 - protein, 12 aa, Homo sapiens
ASRGGLASNEQF

SEQ ID NO: 100 - protein, 6 aa, Homo sapiens
SSVSVY

SEQ ID NO: 101 - protein, 8 aa, Homo sapiens
YLSGSTLV

SEQ ID NO: 102 - protein, 12 aa, Homo sapiens
AVSEGGGSYIPT

SEQ ID NO: 103 - protein, 5 aa, Homo sapiens
LNHDA

SEQ ID NO: 104 - protein, 6 aa, Homo sapiens
SQIVND

SEQ ID NO: 105 - protein, 11 aa, Homo sapiens
ASSLGTFYEQY

SEQ ID NO: 106 - protein, 6 aa, Homo sapiens
DSASNY

SEQ ID NO: 107 - protein, 7 aa, Homo sapiens
IRSNVGE

SEQ ID NO: 108 - protein, 12 aa, Homo sapiens
  misc_feature (10)..(10): Xaa can be lysine or homocitrulline
AASGNTNAGXST

SEQ ID NO: 109 - protein, 6 aa, Homo sapiens
YFSETQ

SEQ ID NO: 110 - protein, 5 aa, Homo sapiens
SGHRS

SEQ ID NO: 111 - protein, 15 aa, Homo sapiens
ASSLGVMVVSTDTQY

SEQ ID NO: 112 - protein, 15 aa, Homo sapiens
  misc_feature (13)..(13): Xaa can be lysine or homocitrulline
ILRDRVSNFGNEXLT

SEQ ID NO: 113 - protein, 5 aa, Homo sapiens
SGHAT

SEQ ID NO: 114 - protein, 6 aa, Homo sapiens
FQNNGV

SEQ ID NO: 115 - protein, 13 aa, Homo sapiens
ASSPTQGASYEQY

SEQ ID NO: 116 - protein, 6 aa, Homo sapiens
VSGNPY

SEQ ID NO: 117 - protein, 8 aa, Homo sapiens
YITGDNLV

SEQ ID NO: 118 - protein, 11 aa, Homo sapiens
AVRDAGYSTLT

SEQ ID NO: 119 - protein, 11 aa, Homo sapiens
  misc_feature (9)..(9): Xaa can be lysine or homocitrulline
AASIDRDDXII

SEQ ID NO: 120 - protein, 5 aa, Homo sapiens
MDHEN

SEQ ID NO: 121 - protein, 6 aa, Homo sapiens
  misc_feature (5)..(5): Xaa can be lysine or homocitrulline
SYDVXM

SEQ ID NO: 122 - protein, 11 aa, Homo sapiens
ATTQGSYNEQF

SEQ ID NO: 123 - protein, 6 aa, Homo sapiens
VSGLRG

SEQ ID NO: 124 - protein, 7 aa, Homo sapiens
LYSAGEE

SEQ ID NO: 125 - protein, 10 aa, Homo sapiens
AVQAGSYIPT

SEQ ID NO: 126 - protein, 11 aa, Homo sapiens
SARTSGTNTQY

SEQ ID NO: 127 - protein, 6 aa, Homo sapiens
SSVPPY

SEQ ID NO: 128 - protein, 8 aa, Homo sapiens
YTSAATLV

SEQ ID NO: 129 - protein, 11 aa, Homo sapiens
  misc_feature (9)..(9): Xaa can be lysine or homocitrulline
AVSGRNDYXLS

SEQ ID NO: 130 - protein, 5 aa, Homo sapiens
MNHEY

SEQ ID NO: 131 - protein, 6 aa, Homo sapiens
SVGEGT

SEQ ID NO: 132 - protein, 12 aa, Homo sapiens
ASSRSWTASGYT

SEQ ID NO: 133 - protein, 12 aa, Homo sapiens
  misc_feature (10)..(10): Xaa can be lysine or homocitrulline
ILRDGSGNEXLT

SEQ ID NO: 134 - protein, 5 aa, Homo sapiens
SGHNS

SEQ ID NO: 135 - protein, 14 aa, Homo sapiens
  misc_feature (10)..(10): Xaa can be lysine or homocitrulline
ASSVAQLAGXGEQF

SEQ ID NO: 136 - protein, 5 aa, Homo sapiens
SNHLY

SEQ ID NO: 137 - protein, 6 aa, Homo sapiens
FYNNEI

SEQ ID NO: 138 - protein, 11 aa, Homo sapiens
ASRRVMGYGYT

SEQ ID NO: 139 - protein, 6 aa, Homo sapiens
DSAIYN

SEQ ID NO: 140 - protein, 7 aa, Homo sapiens
IQSSQRE

SEQ ID NO: 141 - protein, 12 aa, Homo sapiens
  misc_feature (10)..(10): Xaa can be lysine or homocitrulline
ALNSGGSNYXLT

SEQ ID NO: 142 - protein, 14 aa, Homo sapiens
SAGRAGTSGTYEQY

SEQ ID NO: 143 - protein, 12 aa, Homo sapiens
  misc_feature (10)..(10): Xaa can be lysine or homocitrulline
ILRSNFGNEXLT

SEQ ID NO: 144 - protein, 12 aa, Homo sapiens
ASSGGQFNQPQH

SEQ ID NO: 145 - protein, 6 aa, Homo sapiens
NYSPAY

SEQ ID NO: 146 - protein, 7 aa, Homo sapiens
  misc_feature (6)..(6): Xaa can be lysine or homocitrulline
IRENEXE

SEQ ID NO: 147 - protein, 11 aa, Homo sapiens
ALGQTGANNLF

SEQ ID NO: 148 - protein, 5 aa, Homo sapiens
  misc_feature (1)..(1): Xaa can be lysine or homocitrulline
XGHSH

SEQ ID NO: 149 - protein, 6 aa, Homo sapiens
  misc_feature (3)..(3): Xaa can be lysine or homocitrulline
LQXENI

SEQ ID NO: 150 - protein, 14 aa, Homo sapiens
ASSPEALANTGELF

SEQ ID NO: 151 - protein, 7 aa, Homo sapiens
TISGNEY

SEQ ID NO: 152 - protein, 5 aa, Homo sapiens
  misc_feature (3)..(3): Xaa can be lysine or homocitrulline
GLXNN

SEQ ID NO: 153 - protein, 12 aa, Homo sapiens
IVRVGYNNNDMR

SEQ ID NO: 154 - protein, 5 aa, Homo sapiens
  misc_feature (1)..(1): Xaa can be lysine or homocitrulline
XGHDR

SEQ ID NO: 155 - protein, 6 aa, Homo sapiens
  misc_feature (5)..(5): Xaa can be lysine or homocitrulline
SFDVXD

SEQ ID NO: 156 - protein, 13 aa, Homo sapiens
ATSDPSGPPYEQY

SEQ ID NO: 157 - protein, 12 aa, Homo sapiens
  misc_feature (10)..(10): Xaa can be lysine or homocitrulline
ILRAQGGSEXLV

SEQ ID NO: 158 - protein, 12 aa, Homo sapiens
ASRAGTGIGGYT

SEQ ID NO: 159 - protein, 12 aa, Homo sapiens
  misc_feature (10)..(10): Xaa can be lysine or homocitrulline
AVYSGGSNYXLT

SEQ ID NO: 160 - protein, 11 aa, Homo sapiens
ASSLLGSSPLH

SEQ ID NO: 161 - protein, 7 aa, Homo sapiens
TSESDYY

SEQ ID NO: 162 - protein, 8 aa, Homo sapiens
  misc_feature (5)..(5): Xaa can be lysine or homocitrulline
QEAYXQQN

SEQ ID NO: 163 - protein, 12 aa, Homo sapiens
  misc_feature (10)..(10): Xaa can be lysine or homocitrulline
AYRSYNQGGXLI

SEQ ID NO: 164 - protein, 5 aa, Homo sapiens
LGHDT

SEQ ID NO: 165 - protein, 6 aa, Homo sapiens
  misc_feature (4)..(4): Xaa can be lysine or homocitrulline
YNNXEL

SEQ ID NO: 166 - protein, 13 aa, Homo sapiens
ASSQEPSTHNEQF

SEQ ID NO: 167 - protein, 13 aa, Homo sapiens
  misc_feature (3)..(3): Xaa can be lysine or homocitrulline
ILXNYGGSQGNLI

SEQ ID NO: 168 - protein, 5 aa, Homo sapiens
MNHNY

SEQ ID NO: 169 - protein, 6 aa, Homo sapiens
SVGAGI

SEQ ID NO: 170 - protein, 11 aa, Homo sapiens
ASSPGQPYGYT

SEQ ID NO: 171 - protein, 6 aa, Homo sapiens
YSGSPE

SEQ ID NO: 172 - protein, 4 aa, Homo sapiens
HISR

SEQ ID NO: 173 - protein, 12 aa, Homo sapiens
ALSGPSYGQNFV

SEQ ID NO: 174 - protein, 5 aa, Homo sapiens
MNHNS

SEQ ID NO: 175 - protein, 6 aa, Homo sapiens
SASEGT

SEQ ID NO: 176 - protein, 12 aa, Homo sapiens
ASEGLASYNEQF

SEQ ID NO: 177 - protein, 6 aa, Homo sapiens
ATGYPS

SEQ ID NO: 178 - protein, 7 aa, Homo sapiens
  misc_feature (3)..(3): Xaa can be lysine or homocitrulline
  misc_feature (7)..(7): Xaa can be lysine or homocitrulline
ATXADDX

SEQ ID NO: 179 - protein, 11 aa, Homo sapiens
  misc_feature (9)..(9): Xaa can be lysine or homocitrulline
ALTGGGYQXVT

SEQ ID NO: 180 - protein, 6 aa, Homo sapiens
SMNVEV

SEQ ID NO: 181 - protein, 11 aa, Homo sapiens
  misc_feature (9)..(9): Xaa can be lysine or homocitrulline
ASSFREGEXLF

SEQ ID NO: 182 - protein, 5 aa, Homo sapiens
TSINN

SEQ ID NO: 183 - protein, 7 aa, Homo sapiens
IRSNERE

SEQ ID NO: 184 - protein, 12 aa, Homo sapiens
  misc_feature (10)..(10): Xaa can be lysine or homocitrulline
ATAMNTGFQXLV

SEQ ID NO: 185 - protein, 5 aa, Homo sapiens
LGHNA

SEQ ID NO: 186 - protein, 6 aa, Homo sapiens
  misc_feature (4)..(4): Xaa can be lysine or homocitrulline
YNFXEQ

SEQ ID NO: 187 - protein, 14 aa, Homo sapiens
ASSREGLAGLNEQF

SEQ ID NO: 188 - protein, 6 aa, Homo sapiens
NSMFDY

SEQ ID NO: 189 - protein, 9 aa, Homo sapiens
  misc_feature (7)..(7): Xaa can be lysine or homocitrulline
  misc_feature (9)..(9): Xaa can be lysine or homocitrulline
ISISSIXDX

SEQ ID NO: 190 - protein, 15 aa, Homo sapiens
  misc_feature (13)..(13): Xaa can be lysine or homocitrulline
AASGWGDGGATNXLI

SEQ ID NO: 191 - protein, 13 aa, Homo sapiens
GFFLLTRILTIPQ

SEQ ID NO: 192 - protein, 16 aa, Homo sapiens
  misc_feature (12)..(12): Xaa can be lysine or homocitrulline
  misc_feature (14)..(14): Xaa can be lysine or homocitrulline
NQDFTNCITINXLXNS

SEQ ID NO: 193 - protein, 16 aa, Homo sapiens
LQYMCITADQAAGGLR

SEQ ID NO: 194 - protein, 19 aa, Homo sapiens
  misc_feature (14)..(14): Xaa can be lysine or homocitrulline
LSDHHVYLEGTLLXPNMVT

SEQ ID NO: 195 - protein, 20 aa, murine
  misc_feature (6)..(6): Xaa can be lysine or homocitrulline
HACTQXFSHNEEIAMATVTA

SEQ ID NO: 196 - protein, 24 aa, Homo sapiens
  misc_feature (9)..(9): Xaa can be lysine or homocitrulline
  misc_feature (15)..(15): Xaa can be lysine or homocitrulline
LPLVDTHSXRTLLIXTVETRDGQV

SEQ ID NO: 197 - protein, 9 aa, Homo sapiens
  misc_feature (3)..(3): Xaa can be lysine or homocitrulline
IDXVRFLEQ

SEQ ID NO: 198 - protein, 9 aa, Homo sapiens
  misc_feature (4)..(4): Xaa can be lysine or homocitrulline
YIDXVRFLE

SEQ ID NO: 199 - protein, 9 aa, Homo sapiens
  misc_feature (1)..(1): Xaa can be lysine or homocitrulline
XVRFLEQQN

SEQ ID NO: 200 - protein, 9 aa, Homo sapiens
  misc_feature (8)..(8): Xaa can be lysine or homocitrulline
RFLEQQNXI

SEQ ID NO: 201 - protein, 9 aa, Homo sapiens
  misc_feature (9)..(9): Xaa can be lysine or homocitrulline
VRFLEQQNX

SEQ ID NO: 202 - protein, 9 aa, Homo sapiens
  misc_feature (7)..(7): Xaa can be lysine or homocitrulline
FLEQQNXIL

SEQ ID NO: 203 - protein, 9 aa, Homo sapiens
  misc_feature (1)..(1): Xaa can be lysine or homocitrulline
XVESLQEEI

SEQ ID NO: 204 - protein, 9 aa, Homo sapiens
  misc_feature (4)..(4): Xaa can be lysine or homocitrulline
LERXVESLQ

SEQ ID NO: 205 - protein, 9 aa, Homo sapiens
  misc_feature (8)..(8): Xaa can be lysine or homocitrulline
ARLDLERXV

SEQ ID NO: 206 - protein, 9 aa, Homo sapiens
  misc_feature (6)..(6): Xaa can be lysine or homocitrulline
LDLERXVES

SEQ ID NO: 207 - protein, 9 aa, Homo sapiens
  misc_feature (3)..(3): Xaa can be lysine or homocitrulline
ERXVESLQE

SEQ ID NO: 208 - protein, 9 aa, Homo sapiens
  misc_feature (5)..(5): Xaa can be lysine or homocitrulline
DLERXVESL

SEQ ID NO: 209 - protein, 9 aa, Homo sapiens
  misc_feature (3)..(3): Xaa can be lysine or homocitrulline
VSXPDLTAA

SEQ ID NO: 210 - protein, 9 aa, Homo sapiens
  misc_feature (2)..(2): Xaa can be lysine or homocitrulline
SXPDLTAAL

SEQ ID NO: 211 - protein, 9 aa, Homo sapiens
  misc_feature (7)..(7): Xaa can be lysine or homocitrulline
IDVDVSXPD

SEQ ID NO: 212 - protein, 9 aa, Homo sapiens
  misc_feature (5)..(5): Xaa can be lysine or homocitrulline
VDVSXPDLT

SEQ ID NO: 213 - protein, 9 aa, Homo sapiens
  misc_feature (1)..(1): Xaa can be lysine or homocitrulline
XPDLTAALR

SEQ ID NO: 214 - protein, 9 aa, Homo sapiens
  misc_feature (1)..(1): Xaa can be lysine or homocitrulline
  misc_feature (3)..(3): Xaa can be lysine or homocitrulline
XSXFADLSE

SEQ ID NO: 215 - protein, 9 aa, Homo sapiens
  misc_feature (3)..(3): Xaa can be lysine or homocitrulline
  misc_feature (5)..(5): Xaa can be lysine or homocitrulline
WYXSXFADL

SEQ ID NO: 216 - protein, 9 aa, Homo sapiens
  misc_feature (1)..(1): Xaa can be lysine or homocitrulline
XFADLSEAA

SEQ ID NO: 217 - protein, 9 aa, Homo sapiens
  misc_feature (2)..(2): Xaa can be lysine or homocitrulline
  misc_feature (4)..(4): Xaa can be lysine or homocitrulline
YXSXFADLS

SEQ ID NO: 218 - protein, 9 aa, Homo sapiens
  misc_feature (4)..(4): Xaa can be lysine or homocitrulline
THSXRTLLI

SEQ ID NO: 219 - protein, 9 aa, Homo sapiens
  misc_feature (5)..(5): Xaa can be lysine or homocitrulline
TLLIXTVET

SEQ ID NO: 220 - protein, 9 aa, Homo sapiens
  misc_feature (3)..(3): Xaa can be lysine or homocitrulline
  misc_feature (9)..(9): Xaa can be lysine or homocitrulline
HSXRTLLIX

SEQ ID NO: 221 - protein, 9 aa, Homo sapiens
  misc_feature (2)..(2): Xaa can be lysine or homocitrulline
IXTVETRDG

SEQ ID NO: 222 - protein, 9 aa, Homo sapiens
  misc_feature (3)..(3): Xaa can be lysine or homocitrulline
LIXTVETRD

SEQ ID NO: 223 - protein, 9 aa, Homo sapiens
  misc_feature (4)..(4): Xaa can be lysine or homocitrulline
LLIXTVETR

SEQ ID NO: 224 - protein, 9 aa, Homo sapiens
  misc_feature (1)..(1): Xaa can be lysine or homocitrulline
  misc_feature (7)..(7): Xaa can be lysine or homocitrulline
XRTLLIXTV

SEQ ID NO: 225 - protein, 9 aa, Homo sapiens
  misc_feature (9)..(9): Xaa can be lysine or homocitrulline
LFHETLYQX

SEQ ID NO: 226 - protein, 9 aa, Homo sapiens
  misc_feature (2)..(2): Xaa can be lysine or homocitrulline
  misc_feature (8)..(8): Xaa can be lysine or homocitrulline
AXWRCVLXI

SEQ ID NO: 227 - protein, 9 aa, Homo sapiens
  misc_feature (4)..(4): Xaa can be lysine or homocitrulline
DFAXWRCVL

SEQ ID NO: 228 - protein, 9 aa, Homo sapiens
  misc_feature (3)..(3): Xaa can be lysine or homocitrulline
  misc_feature (9)..(9): Xaa can be lysine or homocitrulline
FAXWRCVLX

SEQ ID NO: 229 - protein, 9 aa, Homo sapiens
  misc_feature (8)..(8): Xaa can be lysine or homocitrulline
YLEGTLLXP

SEQ ID NO: 230 - protein, 9 aa, Homo sapiens
  misc_feature (9)..(9): Xaa can be lysine or homocitrulline
IYLEGTLLX

SEQ ID NO: 231 - protein, 9 aa, Homo sapiens
  misc_feature (5)..(5): Xaa can be lysine or homocitrulline
GTLLXPNMV

SEQ ID NO: 232 - protein, 9 aa, Homo sapiens
  misc_feature (3)..(3): Xaa can be lysine or homocitrulline
TQXFSHEEI

SEQ ID NO: 233 - protein, 9 aa, Homo sapiens
  misc_feature (1)..(1): Xaa can be lysine or homocitrulline
XFSHEEIAM

SEQ ID NO: 234 - protein, 9 aa, Homo sapiens
  misc_feature (1)..(1): Xaa can be lysine or homocitrulline
XPWALTFSY

SEQ ID NO: 235 - protein, 9 aa, Homo sapiens
  misc_feature (3)..(3): Xaa can be lysine or homocitrulline
LLXPWALTF

SEQ ID NO: 236 - protein, 9 aa, Homo sapiens
  misc_feature (5)..(5): Xaa can be lysine or homocitrulline
CPLLXPWAL

SEQ ID NO: 237 - protein, 9 aa, Homo sapiens
  misc_feature (5)..(5): Xaa can be lysine or homocitrulline
SFIDXVRFL

SEQ ID NO: 238 - protein, 9 aa, Homo sapiens
  misc_feature (4)..(4): Xaa can be lysine or homocitrulline
FIDXVRFLE

SEQ ID NO: 239 - protein, 9 aa, Homo sapiens
  misc_feature (7)..(7): Xaa can be lysine or homocitrulline
FLEQQNXML

SEQ ID NO: 240 - protein, 9 aa, Homo sapiens
  misc_feature (7)..(7): Xaa can be lysine or homocitrulline
FASFIDXVR

SEQ ID NO: 241 - protein, 9 aa, Homo sapiens
  misc_feature (5)..(5): Xaa can be lysine or homocitrulline
MLETXWSLL

SEQ ID NO: 242 - protein, 9 aa, Homo sapiens
  misc_feature (4)..(4): Xaa can be lysine or homocitrulline
LETXWSLLQ

SEQ ID NO: 243 - protein, 9 aa, Homo sapiens
  misc_feature (3)..(3): Xaa can be lysine or homocitrulline
  misc_feature (8)..(8): Xaa can be lysine or homocitrulline
QNXMLETXW

SEQ ID NO: 244 - protein, 9 aa, Homo sapiens
  misc_feature (1)..(1): Xaa can be lysine or homocitrulline
  misc_feature (9)..(9): Xaa can be lysine or homocitrulline
XWSLLQQQX

SEQ ID NO: 245 - protein, 9 aa, Homo sapiens
  misc_feature (9)..(9): Xaa can be lysine or homocitrulline
MENEFVLIX

SEQ ID NO: 246 - protein, 9 aa, Homo sapiens
  misc_feature (5)..(6): Xaa can be lysine or homocitrulline
FVLIXXDVD

SEQ ID NO: 247 - protein, 9 aa, Homo sapiens
  misc_feature (3)..(3): Xaa can be lysine or homocitrulline
INXRTEMEN

SEQ ID NO: 248 - protein, 9 aa, Homo sapiens
  misc_feature (5)..(5): Xaa can be lysine or homocitrulline
LMNVXLALD

SEQ ID NO: 249 - protein, 9 aa, Homo sapiens
  misc_feature (6)..(6): Xaa can be lysine or homocitrulline
ELMNVXLAL

SEQ ID NO: 250 - protein, 9 aa, Homo sapiens
  misc_feature (8)..(8): Xaa can be lysine or homocitrulline
YQELMNVXL

SEQ ID NO: 251 - protein, 9 aa, Homo sapiens
  misc_feature (8)..(8): Xaa can be lysine or homocitrulline
IEIATYRXL

SEQ ID NO: 252 - protein, 9 aa, Homo sapiens
  misc_feature (6)..(6): Xaa can be lysine or homocitrulline
IATYRXLLE

SEQ ID NO: 253 - protein, 9 aa, Homo sapiens
LDIEIATYR

SEQ ID NO: 254 - protein, 9 aa, Homo sapiens
  misc_feature (3)..(3): Xaa can be lysine or homocitrulline
YRXLLEGEE

SEQ ID NO: 255 - protein, 9 aa, Homo sapiens
  misc_feature (7)..(7): Xaa can be lysine or homocitrulline
CQYVTEXVL

SEQ ID NO: 256 - protein, 9 aa, Homo sapiens
  misc_feature (5)..(5): Xaa can be lysine or homocitrulline
YVTEXVLAA

SEQ ID NO: 257 - protein, 9 aa, Homo sapiens
  misc_feature (1)..(1): Xaa can be lysine or homocitrulline
XRALANSLA

SEQ ID NO: 258 - protein, 9 aa, Homo sapiens
  misc_feature (3)..(3): Xaa can be lysine or homocitrulline
YVXRALANS

SEQ ID NO: 259 - protein, 9 aa, Homo sapiens
  misc_feature (5)..(5): Xaa can be lysine or homocitrulline
EEYVXRALA

SEQ ID NO: 260 - protein, 9 aa, Homo sapiens
  misc_feature (2)..(2): Xaa can be lysine or homocitrulline
VXRALANSL

SEQ ID NO: 261 - protein, 9 aa, Homo sapiens
  misc_feature (2)..(2): Xaa can be lysine or homocitrulline
YXALSDHHI

SEQ ID NO: 262 - protein, 9 aa, Homo sapiens
  misc_feature (3)..(3): Xaa can be lysine or homocitrulline
VYXALSDHH

SEQ ID NO: 263 - protein, 9 aa, Homo sapiens
  misc_feature (1)..(1): Xaa can be lysine or homocitrulline
  misc_feature (8)..(8): Xaa can be lysine or homocitrulline
XVLAAVYXA

SEQ ID NO: 264 - protein, 9 aa, Homo sapiens
  misc_feature (6)..(6): Xaa can be lysine or homocitrulline
LAAVYXALS

SEQ ID NO: 265 - protein, 9 aa, Homo sapiens
  misc_feature (7)..(7): Xaa can be lysine or homocitrulline
AINTEFXNT

SEQ ID NO: 266 - protein, 9 aa, Homo sapiens
  misc_feature (2)..(2): Xaa can be lysine or homocitrulline
  misc_feature (9)..(9): Xaa can be lysine or homocitrulline
FXNTRTNEX

SEQ ID NO: 267 - protein, 9 aa, Homo sapiens
  misc_feature (3)..(3): Xaa can be lysine or homocitrulline
EFXNTRTNE

SEQ ID NO: 268 - protein, 9 aa, Homo sapiens
  misc_feature (6)..(6): Xaa can be lysine or homocitrulline
TRTNEXVEL

SEQ ID NO: 269 - protein, 9 aa, Homo sapiens
  misc_feature (6)..(6): Xaa can be lysine or homocitrulline
INTEFXNTR

SEQ ID NO: 270 - protein, 9 aa, Homo sapiens
  misc_feature (5)..(5): Xaa can be lysine or homocitrulline
NTEFXNTRT

SEQ ID NO: 271 - protein, 9 aa, Homo sapiens
  misc_feature (3)..(3): Xaa can be lysine or homocitrulline
ETXWSLLQQ

SEQ ID NO: 272 - protein, 9 aa, Homo sapiens
  misc_feature (8)..(8): Xaa can be lysine or homocitrulline
WSLLQQQXT

SEQ ID NO: 273 - protein, 9 aa, Homo sapiens
  misc_feature (5)..(5): Xaa can be lysine or homocitrulline
LQQQXTARS

SEQ ID NO: 274 - protein, 9 aa, Homo sapiens
  misc_feature (1)..(1): Xaa can be lysine or homocitrulline
  misc_feature (8)..(8): Xaa can be lysine or homocitrulline
XFASFIDXV

SEQ ID NO: 275 - protein, 9 aa, Homo sapiens
  misc_feature (5)..(5): Xaa can be lysine or homocitrulline
SLNNXFASF

SEQ ID NO: 276 - protein, 9 aa, Homo sapiens
  misc_feature (2)..(2): Xaa can be lysine or homocitrulline
  misc_feature (7)..(7): Xaa can be lysine or homocitrulline
IXSLNNXFA

SEQ ID NO: 277 - protein, 9 aa, Homo sapiens
  misc_feature (4)..(4): Xaa can be lysine or homocitrulline
LNNXFASFI

SEQ ID NO: 278 - protein, 9 aa, Homo sapiens
  misc_feature (6)..(7): Xaa can be lysine or homocitrulline
EFVLIXXDV

SEQ ID NO: 279 - protein, 9 aa, Homo sapiens
  misc_feature (2)..(3): Xaa can be lysine or homocitrulline
IXXDVDEAY

SEQ ID NO: 280 - protein, 9 aa, Homo sapiens
  misc_feature (1)..(2): Xaa can be lysine or homocitrulline
XXDVDEAYM

SEQ ID NO: 281 - protein, 9 aa, Homo sapiens
  misc_feature (5)..(5): Xaa can be lysine or homocitrulline
LRRTXTEIS

SEQ ID NO: 282 - protein, 9 aa, Homo sapiens
  misc_feature (4)..(4): Xaa can be lysine or homocitrulline
RRTXTEISE

SEQ ID NO: 283 - protein, 20 aa, Homo sapiens
  misc_feature (13)..(13): Xaa can be lysine or homocitrulline
RQLREYQELMNVXLALDIEI

SEQ ID NO: 284 - protein, 9 aa, Homo sapiens
  misc_feature (2)..(2): Xaa can be lysine or homocitrulline
LXGQRASLE

SEQ ID NO: 285 - protein, 9 aa, Homo sapiens
  misc_feature (5)..(5): Xaa can be lysine or homocitrulline
IEGLXGQRA

SEQ ID NO: 286 - protein, 9 aa, Homo sapiens
  misc_feature (5)..(5): Xaa can be lysine or homocitrulline
DANAXLSEL

SEQ ID NO: 287 - protein, 9 aa, Homo sapiens
  misc_feature (4)..(4): Xaa can be lysine or homocitrulline
  misc_feature (9)..(9): Xaa can be lysine or homocitrulline
LAIXDANAX

SEQ ID NO: 288 - protein, 9 aa, Homo sapiens
  misc_feature (3)..(3): Xaa can be lysine or homocitrulline
  misc_feature (8)..(8): Xaa can be lysine or homocitrulline
AIXDANAXL

SEQ ID NO: 289 - protein, 9 aa, Homo sapiens
  misc_feature (2)..(2): Xaa can be lysine or homocitrulline
  misc_feature (7)..(7): Xaa can be lysine or homocitrulline
IXDANAXLS

SEQ ID NO: 290 - protein, 9 aa, Homo sapiens
  misc_feature (2)..(2): Xaa can be lysine or homocitrulline
  misc_feature (7)..(7): Xaa can be lysine or homocitrulline
IXFLPFXVV

SEQ ID NO: 291 - protein, 9 aa, Homo sapiens
  misc_feature (4)..(4): Xaa can be lysine or homocitrulline
  misc_feature (9)..(9): Xaa can be lysine or homocitrulline
QDIXFLPFX

SEQ ID NO: 292 - protein, 9 aa, Homo sapiens
  misc_feature (5)..(5): Xaa can be lysine or homocitrulline
QQDIXFLPF

SEQ ID NO: 293 - protein, 9 aa, Homo sapiens
  misc_feature (5)..(5): Xaa can be lysine or homocitrulline
  misc_feature (9)..(9): Xaa can be lysine or homocitrulline
FLPFXVVEX

SEQ ID NO: 294 - protein, 9 aa, Homo sapiens
  misc_feature (3)..(3): Xaa can be lysine or homocitrulline
  misc_feature (8)..(8): Xaa can be lysine or homocitrulline
DIXFLPFXV

SEQ ID NO: 295 - protein, 9 aa, Homo sapiens
  misc_feature (6)..(6): Xaa can be lysine or homocitrulline
VQQDIXFLP

SEQ ID NO: 296 - protein, 9 aa, Homo sapiens
  misc_feature (7)..(7): Xaa can be lysine or homocitrulline
SVQQDIXFL

SEQ ID NO: 297 - protein, 9 aa, Homo sapiens
  misc_feature (5)..(5): Xaa can be lysine or homocitrulline
  misc_feature (7)..(7): Xaa can be lysine or homocitrulline
MVLTXMXET

SEQ ID NO: 298 - protein, 9 aa, Homo sapiens
  misc_feature (7)..(7): Xaa can be lysine or homocitrulline
  misc_feature (9)..(9): Xaa can be lysine or homocitrulline
SAMVLTXMX

SEQ ID NO: 299 - protein, 9 aa, Homo sapiens
  misc_feature (8)..(8): Xaa can be lysine or homocitrulline
ISAMVLTXM

SEQ ID NO: 300 - protein, 9 aa, Homo sapiens
  misc_feature (3)..(3): Xaa can be lysine or homocitrulline
  misc_feature (5)..(5): Xaa can be lysine or homocitrulline
LTXMXETAE

SEQ ID NO: 301 - protein, 9 aa, Homo sapiens
  misc_feature (8)..(8): Xaa can be lysine or homocitrulline
RVMEHFIXL

SEQ ID NO: 302 - protein, 9 aa, Homo sapiens
  misc_feature (9)..(9): Xaa can be lysine or homocitrulline
QRVMEHFIX

SEQ ID NO: 303 - protein, 9 aa, Homo sapiens
  misc_feature (3)..(3): Xaa can be lysine or homocitrulline
  misc_feature (6)..(8): Xaa can be lysine or homocitrulline
FIXLYXXXT

SEQ ID NO: 304 - protein, 9 aa, Homo sapiens
  misc_feature (7)..(7): Xaa can be lysine or homocitrulline
VMEHFIXLY

SEQ ID NO: 305 - protein, 9 aa, Homo sapiens
  misc_feature (1)..(1): Xaa can be lysine or homocitrulline
XRALSSQHQ

SEQ ID NO: 306 - protein, 9 aa, Homo sapiens
  misc_feature (2)..(2): Xaa can be lysine or homocitrulline
  misc_feature (4)..(4): Xaa can be lysine or homocitrulline
EXAXRALSS

SEQ ID NO: 307 - protein, 9 aa, Homo sapiens
  misc_feature (7)..(7): Xaa can be lysine or homocitrulline
  misc_feature (9)..(9): Xaa can be lysine or homocitrulline
LRREVEXAX

SEQ ID NO: 308 - protein, 9 aa, Homo sapiens
  misc_feature (3)..(3): Xaa can be lysine or homocitrulline
  misc_feature (5)..(5): Xaa can be lysine or homocitrulline
VEXAXRALS

SEQ ID NO: 309 - protein, 9 aa, Homo sapiens
  misc_feature (2)..(2): Xaa can be lysine or homocitrulline
AXRALSSQH

SEQ ID NO: 310 - protein, 9 aa, Homo sapiens
  misc_feature (1)..(1): Xaa can be lysine or homocitrulline
  misc_feature (8)..(8): Xaa can be lysine or homocitrulline
XLRREVEXA

SEQ ID NO: 311 - protein, 9 aa, Homo sapiens
  misc_feature (5)..(5): Xaa can be lysine or homocitrulline
  misc_feature (7)..(7): Xaa can be lysine or homocitrulline
REVEXAXRA

SEQ ID NO: 312 - protein, 9 aa, Homo sapiens
  misc_feature (5)..(5): Xaa can be lysine or homocitrulline
LTRAXFEEL

SEQ ID NO: 313 - protein, 9 aa, Homo sapiens
  misc_feature (9)..(9): Xaa can be lysine or homocitrulline
FSETLTRAX

SEQ ID NO: 314 - protein, 9 aa, Homo sapiens
  misc_feature (3)..(3): Xaa can be lysine or homocitrulline
RAXFEELNM

SEQ ID NO: 315 - protein, 9 aa, Homo sapiens
FEELNMDLF

SEQ ID NO: 316 - protein, 9 aa, Homo sapiens
  misc_feature (8)..(8): Xaa can be lysine or homocitrulline
SETLTRAXF

SEQ ID NO: 317 - protein, 9 aa, Homo sapiens
  misc_feature (7)..(7): Xaa can be lysine or homocitrulline
LFRSTMXPV

SEQ ID NO: 318 - protein, 9 aa, Homo sapiens
  misc_feature (6)..(6): Xaa can be lysine or homocitrulline
FRSTMXPVQ

SEQ ID NO: 319 - protein, 9 aa, Homo sapiens
  misc_feature (9)..(9): Xaa can be lysine or homocitrulline
MDLFRSTMX

SEQ ID NO: 320 - protein, 9 aa, Homo sapiens
  misc_feature (4)..(4): Xaa can be lysine or homocitrulline
QLVXEFFNG

SEQ ID NO: 321 - protein, 9 aa, Homo sapiens
  misc_feature (3)..(3): Xaa can be lysine or homocitrulline
  misc_feature (9)..(9): Xaa can be lysine or homocitrulline
LVXEFFNGX

SEQ ID NO: 322 - protein, 9 aa, Homo sapiens
  misc_feature (5)..(5): Xaa can be lysine or homocitrulline
FFNGXEPSR

SEQ ID NO: 323 - protein, 9 aa, Homo sapiens
  misc_feature (6)..(6): Xaa can be lysine or homocitrulline
IQQLVXEFF

SEQ ID NO: 324 - protein, 9 aa, Homo sapiens
  misc_feature (1)..(1): Xaa can be lysine or homocitrulline
XVYEGERPL

SEQ ID NO: 325 - protein, 9 aa, Homo sapiens
  misc_feature (9)..(9): Xaa can be lysine or homocitrulline
YEGERPLTX

SEQ ID NO: 326 - protein, 9 aa, Homo sapiens
  misc_feature (9)..(9): Xaa can be lysine or homocitrulline
LESYAYSLX

SEQ ID NO: 327 - protein, 9 aa, Homo sapiens
  misc_feature (6)..(6): Xaa can be lysine or homocitrulline
YAYSLXNQI

SEQ ID NO: 328 - protein, 9 aa, Homo sapiens
  misc_feature (5)..(5): Xaa can be lysine or homocitrulline
AYSLXNQIG

SEQ ID NO: 329 - protein, 9 aa, Homo sapiens
  misc_feature (8)..(8): Xaa can be lysine or homocitrulline
IVQPIISXL

SEQ ID NO: 330 - protein, 9 aa, Homo sapiens
  misc_feature (7)..(7): Xaa can be lysine or homocitrulline
VQPIISXLY

SEQ ID NO: 331 - protein, 9 aa, Homo sapiens
  misc_feature (8)..(8): Xaa can be lysine or homocitrulline
YLFGCELXA

SEQ ID NO: 332 - protein, 9 aa, Homo sapiens
  misc_feature (7)..(7): Xaa can be lysine or homocitrulline
LFGCELXAD

SEQ ID NO: 333 - protein, 9 aa, Homo sapiens
LRPQNYLFG

SEQ ID NO: 334 - protein, 9 aa, Homo sapiens
  misc_feature (1)..(1): Xaa can be lysine or homocitrulline
  misc_feature (8)..(8): Xaa can be lysine or homocitrulline
XVTLATLXM

SEQ ID NO: 335 - protein, 9 aa, Homo sapiens
  misc_feature (2)..(2): Xaa can be lysine or homocitrulline
LXMSVQPTV

SEQ ID NO: 336 - protein, 9 aa, Homo sapiens
  misc_feature (6)..(6): Xaa can be lysine or homocitrulline
TLATLXMSV

SEQ ID NO: 337 - protein, 9 aa, Homo sapiens
  misc_feature (2)..(2): Xaa can be lysine or homocitrulline
  misc_feature (9)..(9): Xaa can be lysine or homocitrulline
IXVTLATLX

SEQ ID NO: 338 - protein, 9 aa, Homo sapiens
  misc_feature (5)..(5): Xaa can be lysine or homocitrulline
LATLXMSVQ

SEQ ID NO: 339 - protein, 9 aa, Homo sapiens
  misc_feature (1)..(1): Xaa can be lysine or homocitrulline
XMSVQPTVS

SEQ ID NO: 340 - protein, 9 aa, Homo sapiens
  misc_feature (3)..(3): Xaa can be lysine or homocitrulline
TLXMSVQPT

SEQ ID NO: 341 - protein, 9 aa, Homo sapiens
  misc_feature (7)..(7): Xaa can be lysine or homocitrulline
LLSISGXRS

SEQ ID NO: 342 - protein, 9 aa, Homo sapiens
  misc_feature (4)..(4): Xaa can be lysine or homocitrulline
ISGXRSAPG

SEQ ID NO: 343 - protein, 9 aa, Homo sapiens
  misc_feature (1)..(1): Xaa can be lysine or homocitrulline
  misc_feature (8)..(8): Xaa can be lysine or homocitrulline
XLLSISGXR

SEQ ID NO: 344 - protein, 9 aa, Homo sapiens
  misc_feature (2)..(2): Xaa can be lysine or homocitrulline
  misc_feature (9)..(9): Xaa can be lysine or homocitrulline
VXLLSISGX

SEQ ID NO: 345 - protein, 9 aa, Homo sapiens
  misc_feature (2)..(3): Xaa can be lysine or homocitrulline
  misc_feature (6)..(6): Xaa can be lysine or homocitrulline
  misc_feature (9)..(9): Xaa can be lysine or homocitrulline
FXXQEXTPX

SEQ ID NO: 346 - protein, 9 aa, Homo sapiens
  misc_feature (4)..(5): Xaa can be lysine or homocitrulline
  misc_feature (8)..(8): Xaa can be lysine or homocitrulline
ESFXXQEXT

SEQ ID NO: 347 - protein, 9 aa, Homo sapiens
  misc_feature (1)..(2): Xaa can be lysine or homocitrulline
  misc_feature (5)..(5): Xaa can be lysine or homocitrulline
  misc_feature (8)..(8): Xaa can be lysine or homocitrulline
XXQEXTPXT

SEQ ID NO: 348 - protein, 9 aa, Homo sapiens
  misc_feature (1)..(1): Xaa can be lysine or homocitrulline
  misc_feature (5)..(5): Xaa can be lysine or homocitrulline
XVEAXFINY

SEQ ID NO: 349 - protein, 9 aa, Homo sapiens
  misc_feature (4)..(4): Xaa can be lysine or homocitrulline
VEAXFINYV

SEQ ID NO: 350 - protein, 9 aa, Homo sapiens
  misc_feature (6)..(6): Xaa can be lysine or homocitrulline
FINYVXNCF

SEQ ID NO: 351 - protein, 9 aa, Homo sapiens
  misc_feature (3)..(3): Xaa can be lysine or homocitrulline
  misc_feature (9)..(9): Xaa can be lysine or homocitrulline
EAXFINYVX

SEQ ID NO: 352 - protein, 9 aa, Homo sapiens
  misc_feature (3)..(3): Xaa can be lysine or homocitrulline
  misc_feature (7)..(7): Xaa can be lysine or homocitrulline
LPXVEAXFI

SEQ ID NO: 353 - protein, 9 aa, Homo sapiens
  misc_feature (1)..(1): Xaa can be lysine or homocitrulline
  misc_feature (7)..(7): Xaa can be lysine or homocitrulline
XFINYVXNC

SEQ ID NO: 354 - protein, 9 aa, Homo sapiens
  misc_feature (3)..(3): Xaa can be lysine or homocitrulline
YVXNCFRMT

SEQ ID NO: 355 - protein, 9 aa, Homo sapiens
  misc_feature (5)..(5): Xaa can be lysine or homocitrulline
INYVXNCFR

SEQ ID NO: 356 - protein, 9 aa, Homo sapiens
  misc_feature (3)..(3): Xaa can be lysine or homocitrulline
ILXIHAREI

SEQ ID NO: 357 - protein, 9 aa, Homo sapiens
  misc_feature (2)..(2): Xaa can be lysine or homocitrulline
LXIHAREIF

SEQ ID NO: 358 - protein, 9 aa, Homo sapiens
  misc_feature (5)..(5): Xaa can be lysine or homocitrulline
MSILXIHAR

SEQ ID NO: 359 - protein, 9 aa, Homo sapiens
  misc_feature (1)..(1): Xaa can be lysine or homocitrulline
  misc_feature (7)..(7): Xaa can be lysine or homocitrulline
XTRYMGXGV

SEQ ID NO: 360 - protein, 9 aa, Homo sapiens
  misc_feature (4)..(4): Xaa can be lysine or homocitrulline
  misc_feature (8)..(8): Xaa can be lysine or homocitrulline
YMGXGVSXA

SEQ ID NO: 361 - protein, 9 aa, Homo sapiens
  misc_feature (3)..(3): Xaa can be lysine or homocitrulline
  misc_feature (7)..(7): Xaa can be lysine or homocitrulline
MGXGVSXAV

SEQ ID NO: 362 - protein, 9 aa, Homo sapiens
  misc_feature (5)..(5): Xaa can be lysine or homocitrulline
  misc_feature (9)..(9): Xaa can be lysine or homocitrulline
RFMGXGVSX

SEQ ID NO: 363 - protein, 9 aa, Homo sapiens
  misc_feature (1)..(1): Xaa can be lysine or homocitrulline
XFGANAILG

SEQ ID NO: 364 - protein, 9 aa, Homo sapiens
  misc_feature (1)..(1): Xaa can be lysine or homocitrulline
  misc_feature (3)..(3): Xaa can be lysine or homocitrulline
XSXFGANAI

SEQ ID NO: 365 - protein, 9 aa, Homo sapiens
  misc_feature (1)..(1): Xaa can be lysine or homocitrulline
XLAMQEFMI

SEQ ID NO: 366 - protein, 9 aa, Homo sapiens
  misc_feature (5)..(5): Xaa can be lysine or homocitrulline
HAGNXLAMQ

SEQ ID NO: 367 - protein, 9 aa, Homo sapiens
  misc_feature (6)..(6): Xaa can be lysine or homocitrulline
VYHNLXNVI

SEQ ID NO: 368 - protein, 9 aa, Homo sapiens
  misc_feature (5)..(5): Xaa can be lysine or homocitrulline
  misc_feature (9)..(9): Xaa can be lysine or homocitrulline
YHNLXNVIX

SEQ ID NO: 369 - protein, 9 aa, Homo sapiens
  misc_feature (3)..(3): Xaa can be lysine or homocitrulline
YGXDATNVG

SEQ ID NO: 370 - protein, 9 aa, Homo sapiens
  misc_feature (3)..(3): Xaa can be lysine or homocitrulline
  misc_feature (5)..(5): Xaa can be lysine or homocitrulline
  misc_feature (8)..(8): Xaa can be lysine or homocitrulline
VIXEXYGXD

SEQ ID NO: 371 - protein, 9 aa, Homo sapiens
  misc_feature (1)..(1): Xaa can be lysine or homocitrulline
  misc_feature (4)..(4): Xaa can be lysine or homocitrulline
XYGXDATNV

SEQ ID NO: 372 - protein, 9 aa, Homo sapiens
  misc_feature (5)..(5): Xaa can be lysine or homocitrulline
FRSGXYDLD

SEQ ID NO: 373 - protein, 9 aa, Homo sapiens
  misc_feature (6)..(6): Xaa can be lysine or homocitrulline
FFRSGXYDL

SEQ ID NO: 374 - protein, 9 aa, Homo sapiens
  misc_feature (8)..(8): Xaa can be lysine or homocitrulline
SEFFRSGXY

SEQ ID NO: 375 - protein, 9 aa, Homo sapiens
  misc_feature (9)..(9): Xaa can be lysine or homocitrulline
ASEFFRSGX

SEQ ID NO: 376 - protein, 9 aa, Homo sapiens
  misc_feature (5)..(5): Xaa can be lysine or homocitrulline
  misc_feature (9)..(9): Xaa can be lysine or homocitrulline
ADLYXSFIX

SEQ ID NO: 377 - protein, 9 aa, Homo sapiens
  misc_feature (4)..(4): Xaa can be lysine or homocitrulline
  misc_feature (8)..(8): Xaa can be lysine or homocitrulline
DLYXSFIXD

SEQ ID NO: 378 - protein, 9 aa, Homo sapiens
  misc_feature (3)..(3): Xaa can be lysine or homocitrulline
  misc_feature (7)..(7): Xaa can be lysine or homocitrulline
LYXSFIXDY

SEQ ID NO: 379 - protein, 9 aa, Homo sapiens
  misc_feature (2)..(2): Xaa can be lysine or homocitrulline
  misc_feature (6)..(6): Xaa can be lysine or homocitrulline
YXSFIXDYP

SEQ ID NO: 380 - protein, 9 aa, Homo sapiens
  misc_feature (3)..(3): Xaa can be lysine or homocitrulline
FIXDYPVVS

SEQ ID NO: 381 - protein, 9 aa, Homo sapiens
  misc_feature (6)..(6): Xaa can be lysine or homocitrulline
LADLYXSFI

SEQ ID NO: 382 - protein, 9 aa, Homo sapiens
  misc_feature (1)..(1): Xaa can be lysine or homocitrulline
  misc_feature (5)..(5): Xaa can be lysine or homocitrulline
XSFIXDYPV

SEQ ID NO: 383 - protein, 9 aa, Homo sapiens
  misc_feature (1)..(1): Xaa can be lysine or homocitrulline
XFTASAGIQ

SEQ ID NO: 384 - protein, 9 aa, Homo sapiens
  misc_feature (3)..(3): Xaa can be lysine or homocitrulline
WQXFTASAG

SEQ ID NO: 385 - protein, 9 aa, Homo sapiens
  misc_feature (4)..(4): Xaa can be lysine or homocitrulline
AWQXFTASA

SEQ ID NO: 386 - protein, 20 aa, Homo sapiens
  misc_feature (3)..(3): Xaa can be lysine or homocitrulline
  misc_feature (11)..(11): Xaa can be lysine or homocitrulline
NEXSCNCLLLXVNQIGSVTE

SEQ ID NO: 387 - protein, 9 aa, Homo sapiens
  misc_feature (5)..(5): Xaa can be lysine or homocitrulline
CLLLXVNQI

SEQ ID NO: 388 - protein, 9 aa, Homo sapiens
  misc_feature (3)..(3): Xaa can be lysine or homocitrulline
LLXVNQIGS

SEQ ID NO: 389 - protein, 9 aa, Homo sapiens
  misc_feature (8)..(8): Xaa can be lysine or homocitrulline
SCNCLLLXV

SEQ ID NO: 390 - protein, 9 aa, Homo sapiens
  misc_feature (4)..(4): Xaa can be lysine or homocitrulline
RLAXYNQLL

SEQ ID NO: 391 - protein, 9 aa, Homo sapiens
  misc_feature (2)..(2): Xaa can be lysine or homocitrulline
AXYNQLLRI

SEQ ID NO: 392 - protein, 9 aa, Homo sapiens
  misc_feature (3)..(3): Xaa can be lysine or homocitrulline
LAXYNQLLR

SEQ ID NO: 393 - protein, 9 aa, Homo sapiens
  misc_feature (1)..(1): Xaa can be lysine or homocitrulline
  misc_feature (3)..(3): Xaa can be lysine or homocitrulline
XAXFAGRNF

SEQ ID NO: 394 - protein, 9 aa, Homo sapiens
  misc_feature (1)..(1): Xaa can be lysine or homocitrulline
XFAGRNFRN

SEQ ID NO: 395 - protein, 9 aa, Homo sapiens
  misc_feature (2)..(2): Xaa can be lysine or homocitrulline
LXHAVVNLI

SEQ ID NO: 396 - protein, 9 aa, Homo sapiens
  misc_feature (3)..(3): Xaa can be lysine or homocitrulline
MLXHAVVNL

SEQ ID NO: 397 - protein, 9 aa, Homo sapiens
AVVNLINYQ

SEQ ID NO: 398 - protein, 9 aa, Homo sapiens
  misc_feature (8)..(8): Xaa can be lysine or homocitrulline
WTTSRVLXV

SEQ ID NO: 399 - protein, 9 aa, Homo sapiens
  misc_feature (7)..(7): Xaa can be lysine or homocitrulline
TTSRVLXVL

SEQ ID NO: 400 - protein, 9 aa, Homo sapiens
  misc_feature (3)..(3): Xaa can be lysine or homocitrulline
VLXVLSVCS

SEQ ID NO: 401 - protein, 9 aa, Homo sapiens
  misc_feature (2)..(2): Xaa can be lysine or homocitrulline
LXVLSVCSS

SEQ ID NO: 402 - protein, 9 aa, Homo sapiens
  misc_feature (1)..(1): Xaa can be lysine or homocitrulline
XLLWTTSRV

SEQ ID NO: 403 - protein, 9 aa, Homo sapiens
  misc_feature (5)..(5): Xaa can be lysine or homocitrulline
SRVLXVLSV

SEQ ID NO: 404 - protein, 9 aa, Homo sapiens
  misc_feature (8)..(8): Xaa can be lysine or homocitrulline
LLHQEGAXM

SEQ ID NO: 405 - protein, 9 aa, Homo sapiens
  misc_feature (7)..(7): Xaa can be lysine or homocitrulline
LHQEGAXMA

SEQ ID NO: 406 - protein, 9 aa, Homo sapiens
  misc_feature (3)..(3): Xaa can be lysine or homocitrulline
LQXMVALLN

SEQ ID NO: 407 - protein, 9 aa, Homo sapiens
  misc_feature (7)..(7): Xaa can be lysine or homocitrulline
LAGGLQXMV

SEQ ID NO: 408 - protein, 9 aa, Homo sapiens
  misc_feature (4)..(4): Xaa can be lysine or homocitrulline
GLQXMVALL

SEQ ID NO: 409 - protein, 9 aa, Homo sapiens
  misc_feature (9)..(9): Xaa can be lysine or homocitrulline
VRLAGGLQX

SEQ ID NO: 410 - protein, 9 aa, Homo sapiens
  misc_feature (3)..(3): Xaa can be lysine or homocitrulline
NVXFLAITT

SEQ ID NO: 411 - protein, 9 aa, Homo sapiens
  misc_feature (3)..(3): Xaa can be lysine or homocitrulline
YEXLLWTTS

SEQ ID NO: 412 - protein, 9 aa, Homo sapiens
  misc_feature (4)..(4): Xaa can be lysine or homocitrulline
RVLXVLSVC

SEQ ID NO: 413 - protein, 9 aa, Homo sapiens
  misc_feature (9)..(9): Xaa can be lysine or homocitrulline
VLSVCSSNX

SEQ ID NO: 414 - protein, 9 aa, Homo sapiens
  misc_feature (5)..(5): Xaa can be lysine or homocitrulline
PVVVXLLHP

SEQ ID NO: 415 - protein, 9 aa, Homo sapiens
  misc_feature (6)..(6): Xaa can be lysine or homocitrulline
LPVVVXLLH

SEQ ID NO: 416 - protein, 9 aa, Homo sapiens
  misc_feature (4)..(4): Xaa can be lysine or homocitrulline
VVVXLLHPP

SEQ ID NO: 417 - protein, 9 aa, Homo sapiens
  misc_feature (3)..(3): Xaa can be lysine or homocitrulline
VVXLLHPPS

SEQ ID NO: 418 - protein, 9 aa, Homo sapiens
  misc_feature (2)..(2): Xaa can be lysine or homocitrulline
VXLLHPPSH

SEQ ID NO: 419 - protein, 9 aa, Homo sapiens
  misc_feature (2)..(2): Xaa can be lysine or homocitrulline
IXATVGLIR

SEQ ID NO: 420 - protein, 9 aa, Homo sapiens
  misc_feature (3)..(3): Xaa can be lysine or homocitrulline
LIXATVGLI

SEQ ID NO: 421 - protein, 9 aa, Homo sapiens
  misc_feature (5)..(5): Xaa can be lysine or homocitrulline
WPLIXATVG

SEQ ID NO: 422 - protein, 9 aa, Homo sapiens
  misc_feature (6)..(6): Xaa can be lysine or homocitrulline
HWPLIXATV

SEQ ID NO: 423 - protein, 9 aa, Homo sapiens
  misc_feature (9)..(9): Xaa can be lysine or homocitrulline
VLCELAQDX

SEQ ID NO: 424 - protein, 9 aa, Homo sapiens
  misc_feature (9)..(9): Xaa can be lysine or homocitrulline
VLFRMSEDX

SEQ ID NO: 425 - protein, 9 aa, Homo sapiens
  misc_feature (3)..(3): Xaa can be lysine or homocitrulline
  misc_feature (8)..(8): Xaa can be lysine or homocitrulline
IAXEGFEXI

SEQ ID NO: 426 - protein, 9 aa, Homo sapiens
  misc_feature (7)..(7): Xaa can be lysine or homocitrulline
LARSIAXEG

SEQ ID NO: 427 - protein, 9 aa, Homo sapiens
  misc_feature (5)..(5): Xaa can be lysine or homocitrulline
  misc_feature (8)..(8): Xaa can be lysine or homocitrulline
EGFEXISXG

SEQ ID NO: 428 - protein, 9 aa, Homo sapiens
  misc_feature (8)..(8): Xaa can be lysine or homocitrulline
VLARSIAXE

SEQ ID NO: 429 - protein, 9 aa, Homo sapiens
  misc_feature (4)..(4): Xaa can be lysine or homocitrulline
  misc_feature (9)..(9): Xaa can be lysine or homocitrulline
SIAXEGFEX

SEQ ID NO: 430 - protein, 9 aa, Homo sapiens
  misc_feature (5)..(5): Xaa can be lysine or homocitrulline
RSIAXEGFE

SEQ ID NO: 431 - protein, 9 aa, Homo sapiens
  misc_feature (9)..(9): Xaa can be lysine or homocitrulline
STLVLNRLX

SEQ ID NO: 432 - protein, 9 aa, Homo sapiens
  misc_feature (3)..(3): Xaa can be lysine or homocitrulline
RLXVGLQVV

SEQ ID NO: 433 - protein, 9 aa, Homo sapiens
  misc_feature (7)..(7): Xaa can be lysine or homocitrulline
LVLNRLXVG

SEQ ID NO: 434 - protein, 9 aa, Homo sapiens
  misc_feature (8)..(8): Xaa can be lysine or homocitrulline
TLVLNRLXV

SEQ ID NO: 435 - protein, 9 aa, Homo sapiens
  misc_feature (5)..(5): Xaa can be lysine or homocitrulline
LNRLXVGLQ

SEQ ID NO: 436 - protein, 9 aa, Homo sapiens
  misc_feature (1)..(1): Xaa can be lysine or homocitrulline
  misc_feature (8)..(8): Xaa can be lysine or homocitrulline
XLNERLAXL

SEQ ID NO: 437 - protein, 9 aa, Homo sapiens
  misc_feature (7)..(7): Xaa can be lysine or homocitrulline
  misc_feature (9)..(9): Xaa can be lysine or homocitrulline
TTSEYEXEX

SEQ ID NO: 438 - protein, 9 aa, Homo sapiens
  misc_feature (3)..(3): Xaa can be lysine or homocitrulline
  misc_feature (5)..(5): Xaa can be lysine or homocitrulline
YEXEXLNER

SEQ ID NO: 439 - protein, 9 aa, Homo sapiens
  misc_feature (1)..(1): Xaa can be lysine or homocitrulline
  misc_feature (3)..(3): Xaa can be lysine or homocitrulline
XEXLNERLA

SEQ ID NO: 440 - protein, 9 aa, Homo sapiens
  misc_feature (1)..(1): Xaa can be lysine or homocitrulline
XVVRTALLD

SEQ ID NO: 441 - protein, 9 aa, Homo sapiens
  misc_feature (2)..(2): Xaa can be lysine or homocitrulline
TXVVRTALL

SEQ ID NO: 442 - protein, 9 aa, Homo sapiens
  misc_feature (5)..(5): Xaa can be lysine or homocitrulline
IDPTXVVRT

SEQ ID NO: 443 - protein, 9 aa, Homo sapiens
  misc_feature (3)..(3): Xaa can be lysine or homocitrulline
PTXVVRTAL

SEQ ID NO: 444 - protein, 9 aa, Homo sapiens
  misc_feature (2)..(2): Xaa can be lysine or homocitrulline
  misc_feature (7)..(7): Xaa can be lysine or homocitrulline
YXNIGAXLV

SEQ ID NO: 445 - protein, 9 aa, Homo sapiens
  misc_feature (1)..(1): Xaa can be lysine or homocitrulline
  misc_feature (6)..(6): Xaa can be lysine or homocitrulline
XNIGAXLVQ

SEQ ID NO: 446 - protein, 9 aa, Homo sapiens
  misc_feature (1)..(1): Xaa can be lysine or homocitrulline
  misc_feature (3)..(3): Xaa can be lysine or homocitrulline
  misc_feature (8)..(8): Xaa can be lysine or homocitrulline
XYXNIGAXL

SEQ ID NO: 447 - protein, 12 aa, Homo sapiens
ENHRYTISGTDY

SEQ ID NO: 448 - protein, 11 aa, Homo sapiens
  misc_feature (5)..(5): Xaa can be lysine or homocitrulline
SYGVXDGLTSN

SEQ ID NO: 449 - protein, 23 aa, Homo sapiens
  misc_feature (21)..(21): Xaa can be lysine or homocitrulline
AISERRDQETQYILRDVYDYXLS

SEQ ID NO: 450 - protein, 12 aa, Homo sapiens
DFQATTVTNFRS

SEQ ID NO: 451 - protein, 14 aa, Homo sapiens
  misc_feature (6)..(6): Xaa can be lysine or homocitrulline
SNEGSXALTSSGIE

SEQ ID NO: 452 - protein, 20 aa, Homo sapiens
SAPIHTDTQYAVHDAGNMLT

SEQ ID NO: 453 - protein, 11 aa, Homo sapiens
SGHDYSSVSVY

SEQ ID NO: 454 - protein, 14 aa, Homo sapiens
FNNNVPYLSGSTLV

SEQ ID NO: 455 - protein, 24 aa, Homo sapiens
ASRGGLASNEQFAVSEGGGSYIPT

SEQ ID NO: 456 - protein, 11 aa, Homo sapiens
LNHDADSASNY

SEQ ID NO: 457 - protein, 13 aa, Homo sapiens
SQIVNDIRSNVGE

SEQ ID NO: 458 - protein, 23 aa, Homo sapiens
  misc_feature (21)..(21): Xaa can be lysine or homocitrulline
ASSLGTFYEQYAASGNTNAGXST

SEQ ID NO: 459 - protein, 12 aa, Homo sapiens
SGHRSTISGTDY

SEQ ID NO: 460 - protein, 11 aa, Homo sapiens
YFSETQGLTSN

SEQ ID NO: 461 - protein, 30 aa, Homo sapiens
  misc_feature (28)..(28): Xaa can be lysine or homocitrulline
ASSLGVMVVSTDTQYILRDRVSNFGNEXLT

SEQ ID NO: 462 - protein, 11 aa, Homo sapiens
SGHATVSGNPY

SEQ ID NO: 463 - protein, 14 aa, Homo sapiens
FQNNGVYITGDNLV

SEQ ID NO: 464 - protein, 24 aa, Homo sapiens
ASSPTQGASYEQYAVRDAGYSTLT

SEQ ID NO: 465 - protein, 11 aa, Homo sapiens
ENHRYDSASNY

SEQ ID NO: 466 - protein, 13 aa, Homo sapiens
  misc_feature (5)..(5): Xaa can be lysine or homocitrulline
SYGVXDIRSNVGE

SEQ ID NO: 467 - protein, 24 aa, Homo sapiens
  misc_feature (22)..(22): Xaa can be lysine or homocitrulline
AISERRDQETQYAASGNTNAGXST

SEQ ID NO: 468 - protein, 23 aa, Homo sapiens
  misc_feature (21)..(21): Xaa can be lysine or homocitrulline
AISERRDQETQYAASIDRDDXII

SEQ ID NO: 469 - protein, 11 aa, Homo sapiens
MDHENVSGLRG

SEQ ID NO: 470 - protein, 13 aa, Homo sapiens
  misc_feature (5)..(5): Xaa can be lysine or homocitrulline
SYDVXMLYSAGEE

SEQ ID NO: 471 - protein, 21 aa, Homo sapiens
ATTQGSYNEQFAVQAGSYIPT

SEQ ID NO: 472 - protein, 12 aa, Homo sapiens
DFQATTSSVPPY

SEQ ID NO: 473 - protein, 15 aa, Homo sapiens
  misc_feature (6)..(6): Xaa can be lysine or homocitrulline
SNEGSXAYTSAATLV

SEQ ID NO: 474 - protein, 22 aa, Homo sapiens
  misc_feature (20)..(20): Xaa can be lysine or homocitrulline
SARTSGTNTQYAVSGRNDYXLS

SEQ ID NO: 475 - protein, 12 aa, Homo sapiens
MNHEYTISGTDY

SEQ ID NO: 476 - protein, 11 aa, Homo sapiens
SVGEGTGLTSN

SEQ ID NO: 477 - protein, 24 aa, Homo sapiens
  misc_feature (22)..(22): Xaa can be lysine or homocitrulline
ASSRSWTASGYTILRDGSGNEXLT

SEQ ID NO: 478 - protein, 11 aa, Homo sapiens
SGHNSDSASNY

SEQ ID NO: 479 - protein, 13 aa, Homo sapiens
FNNNVPIRSNVGE

SEQ ID NO: 480 - protein, 25 aa, Homo sapiens
  misc_feature (10)..(10): Xaa can be lysine or homocitrulline
  misc_feature (23)..(23): Xaa can be lysine or homocitrulline
ASSVAQLAGXGEQFAASIDRDDXII

SEQ ID NO: 481 - protein, 11 aa, Homo sapiens
SNHLYDSAIYN

SEQ ID NO: 482 - protein, 13 aa, Homo sapiens
FYNNEIIQSSQRE

SEQ ID NO: 483 - protein, 23 aa, Homo sapiens
  misc_feature (21)..(21): Xaa can be lysine or homocitrulline
ASRRVMGYGYTALNSGGSNYXLT

SEQ ID NO: 484 - protein, 13 aa, Homo sapiens
DFQATTTISGTDY

SEQ ID NO: 485 - protein, 12 aa, Homo sapiens
  misc_feature (6)..(6): Xaa can be lysine or homocitrulline
SNEGSXAGLTSN

SEQ ID NO: 486 - protein, 26 aa, Homo sapiens
  misc_feature (24)..(24): Xaa can be lysine or homocitrulline
SAGRAGTSGTYEQYILRSNFGNEXLT

SEQ ID NO: 487 - protein, 11 aa, Homo sapiens
LNHDANYSPAY

SEQ ID NO: 488 - protein, 13 aa, Homo sapiens
  misc_feature (12)..(12): Xaa can be lysine or homocitrulline
SQIVNDIRENEXE

SEQ ID NO: 489 - protein, 23 aa, Homo sapiens
ASSGGQFNQPQHALGQTGANNLF

SEQ ID NO: 490 - protein, 12 aa, Homo sapiens
  misc_feature (1)..(1): Xaa can be lysine or homocitrulline
XGHSHTISGNEY

SEQ ID NO: 491 - protein, 11 aa, Homo sapiens
  misc_feature (3)..(3): Xaa can be lysine or homocitrulline
  misc_feature (9)..(9): Xaa can be lysine or homocitrulline
LQXENIGLXNN

SEQ ID NO: 492 - protein, 26 aa, Homo sapiens
ASSPEALANTGELFIVRVGYNNNDMR

SEQ ID NO: 493 - protein, 12 aa, Homo sapiens
  misc_feature (1)..(1): Xaa can be lysine or homocitrulline
XGHDRTISGTDY

SEQ ID NO: 494 - protein, 11 aa, Homo sapiens
  misc_feature (5)..(5): Xaa can be lysine or homocitrulline
SFDVXDGLTSN

SEQ ID NO: 495 - protein, 25 aa, Homo sapiens
  misc_feature (23)..(23): Xaa can be lysine or homocitrulline
ATSDPSGPPYEQYILRAQGGSEXLV

SEQ ID NO: 496 - protein, 24 aa, Homo sapiens
  misc_feature (22)..(22): Xaa can be lysine or homocitrulline
ASRAGTGIGGYTAVYSGGSNYXLT

SEQ ID NO: 497 - protein, 12 aa, Homo sapiens
MDHENTSESDYY

SEQ ID NO: 498 - protein, 14 aa, Homo sapiens
  misc_feature (5)..(5): Xaa can be lysine or homocitrulline
  misc_feature (11)..(11): Xaa can be lysine or homocitrulline
SYDVXMQEAYXQQN

SEQ ID NO: 499 - protein, 23 aa, Homo sapiens
  misc_feature (21)..(21): Xaa can be lysine or homocitrulline
ASSLLGSSPLHAYRSYNQGGXLI

SEQ ID NO: 500 - protein, 12 aa, Homo sapiens
ENHRYTSESDYY

SEQ ID NO: 501 - protein, 14 aa, Homo sapiens
  misc_feature (5)..(5): Xaa can be lysine or homocitrulline
  misc_feature (11)..(11): Xaa can be lysine or homocitrulline
SYGVXDQEAYXQQN

SEQ ID NO: 502 - protein, 24 aa, Homo sapiens
  misc_feature (22)..(22): Xaa can be lysine or homocitrulline
AISERRDQETQYAYRSYNQGGXLI

SEQ ID NO: 503 - protein, 12 aa, Homo sapiens
LGHDTTISGTDY

SEQ ID NO: 504 - protein, 11 aa, Homo sapiens
  misc_feature (4)..(4): Xaa can be lysine or homocitrulline
YNNXELGLTSN

SEQ ID NO: 505 - protein, 26 aa, Homo sapiens
  misc_feature (16)..(16): Xaa can be lysine or homocitrulline
ASSQEPSTHNEQFILXNYGGSQGNLI

SEQ ID NO: 506 - protein, 11 aa, Homo sapiens
MNHNYYSGSPE

SEQ ID NO: 507 - protein, 10 aa, Homo sapiens
SVGAGIHISR

SEQ ID NO: 508 - protein, 23 aa, Homo sapiens
ASSPGQPYGYTALSGPSYGQNFV

SEQ ID NO: 509 - protein, 11 aa, Homo sapiens
MNHNSATGYPS

SEQ ID NO: 510 - protein, 13 aa, Homo sapiens
  misc_feature (9)..(9): Xaa can be lysine or homocitrulline
  misc_feature (13)..(13): Xaa can be lysine or homocitrulline
SASEGTATXADDX

SEQ ID NO: 511 - protein, 23 aa, Homo sapiens
  misc_feature (21)..(21): Xaa can be lysine or homocitrulline
ASEGLASYNEQFALTGGGYQXVT

SEQ ID NO: 512 - protein, 10 aa, Homo sapiens
MNHEYTSINN

SEQ ID NO: 513 - protein, 13 aa, Homo sapiens
SMNVEVIRSNERE

SEQ ID NO: 514 - protein, 23 aa, Homo sapiens
  misc_feature (9)..(9): Xaa can be lysine or homocitrulline
  misc_feature (21)..(21): Xaa can be lysine or homocitrulline
ASSFREGEXLFATAMNTGFQXLV

SEQ ID NO: 515 - protein, 11 aa, Homo sapiens
LGHNANSMFDY

SEQ ID NO: 516 - protein, 15 aa, Homo sapiens
  misc_feature (4)..(4): Xaa can be lysine or homocitrulline
  misc_feature (13)..(13): Xaa can be lysine or homocitrulline
  misc_feature (15)..(15): Xaa can be lysine or homocitrulline
YNFXEQISISSIXDX

SEQ ID NO: 517 - protein, 29 aa, Homo sapiens
  misc_feature (27)..(27): Xaa can be lysine or homocitrulline
ASSREGLAGLNEQFAASGWGDGGATNXLI

SEQ ID NO: 518 - protein, 19 aa, murine
  misc_feature (6)..(6): Xaa can be lysine or homocitrulline
HACTQXFSNEEIAMATVTA

SEQ ID NO: 519 - protein, 364 aa, Homo sapiens
  misc_feature (13)..(14): Xaa can be lysine or homocitrulline
  misc_feature (28)..(28): Xaa can be lysine or homocitrulline
  misc_feature (42)..(42): Xaa can be lysine or homocitrulline
  misc_feature (87)..(87): Xaa can be lysine or homocitrulline
  misc_feature (99)..(99): Xaa can be lysine or homocitrulline
  misc_feature (101)..(101): Xaa can be lysine or homocitrulline
  misc_feature (108)..(108): Xaa can be lysine or homocitrulline
  misc_feature (111)..(111): Xaa can be lysine or homocitrulline
  misc_feature (139)..(140): Xaa can be lysine or homocitrulline
  misc_feature (147)..(147): Xaa can be lysine or homocitrulline
  misc_feature (153)..(153): Xaa can be lysine or homocitrulline
  misc_feature (200)..(200): Xaa can be lysine or homocitrulline
  misc_feature (208)..(208): Xaa can be lysine or homocitrulline
  misc_feature (215)..(215): Xaa can be lysine or homocitrulline
  misc_feature (230)..(230): Xaa can be lysine or homocitrulline
  misc_feature (243)..(243): Xaa can be lysine or homocitrulline
  misc_feature (289)..(289): Xaa can be lysine or homocitrulline
  misc_feature (294)..(294): Xaa can be lysine or homocitrulline
  misc_feature (312)..(312): Xaa can be lysine or homocitrulline
  misc_feature (317)..(318): Xaa can be lysine or homocitrulline
  misc_feature (322)..(322): Xaa can be lysine or homocitrulline
  misc_feature (330)..(330): Xaa can be lysine or homocitrulline
  misc_feature (342)..(342): Xaa can be lysine or homocitrulline
MPYQYPALTPEQXXELSDIAHRIVAPGXGILAADESTGSIAXRLQSIGTENTEENRRFYRQLLLTADDRVNPCIGGVILFHETLYQXADDGRPFPQVIXSXGGVVGIXVDXGVVPLAGTNGETTTQGLDGLSERCAQYXXDGADFAXWRCVLXIGEHTPSALAIMENANVLARYASICQQNGIVPIVEPEILPDGDHDLXRCQYVTEXVLAAVYXALSDHHIYLEGTLLXPNMVTPGHACTQXFSHEEIAMATVTALRRTVPPAVTGITFLSGGQSEEEASINLNAINXCPLLXPWALTFSYGRALQASALXAWGGXXENLXAAQEEYVXRALANSLACQGXYTPSGQAGAAASESLFVSNHAY

SEQ ID NO: 520 - protein, 364 aa, Homo sapiens
  misc_feature (13)..(14): Xaa can be lysine or homocitrulline
  misc_feature (28)..(28): Xaa can be lysine or homocitrulline
  misc_feature (48)..(48): Xaa can be lysine or homocitrulline
  misc_feature (87)..(87): Xaa can be lysine or homocitrulline
  misc_feature (92)..(92): Xaa can be lysine or homocitrulline
  misc_feature (99)..(99): Xaa can be lysine or homocitrulline
  misc_feature (101)..(101): Xaa can be lysine or homocitrulline
  misc_feature (108)..(108): Xaa can be lysine or homocitrulline
  misc_feature (121)..(121): Xaa can be lysine or homocitrulline
  misc_feature (139)..(140): Xaa can be lysine or homocitrulline
  misc_feature (147)..(147): Xaa can be lysine or homocitrulline
  misc_feature (208)..(208): Xaa can be lysine or homocitrulline
  misc_feature (215)..(215): Xaa can be lysine or homocitrulline
  misc_feature (230)..(230): Xaa can be lysine or homocitrulline
  misc_feature (242)..(243): Xaa can be lysine or homocitrulline
  misc_feature (294)..(294): Xaa can be lysine or homocitrulline
  misc_feature (297)..(297): Xaa can be lysine or homocitrulline
  misc_feature (317)..(317): Xaa can be lysine or homocitrulline
  misc_feature (321)..(321): Xaa can be lysine or homocitrulline
  misc_feature (330)..(330): Xaa can be lysine or homocitrulline
  misc_feature (340)..(340): Xaa can be lysine or homocitrulline
MAHRFPALTQEQXXELSEIAQSIVANGXGILAADESVGTMGNRLQRIXVENTEENRRQFREILFSVDSSINQSIGGVILFHETLYQXDSQGXLFRNILXEXGIVVGIXLDQGGAPLAGTNXETTIQGLDGLSERCAQYXXDGVDFGXWRAVLRIADQCPSSLAIQENANALARYASICQQNGLVPIVEPEVIPDGDHDLEHCQYVTEXVLAAVYXALNDHHVYLEGTLLXPNMVTAGHACTXXYTPEQVAMATVTALHRTVPAAVPGICFLSGGMSEEDATLNLNAINLCPLPXPWXLSFSYGRALQASALAAWGGXAANXEATQEAFMXRAMANCQAAXGQYVHTGSSGAASTQSLFTACYTY

SEQ ID NO: 521 - protein, 294 aa, Homo sapiens
  misc_feature (13)..(14): Xaa can be lysine or homocitrulline
  misc_feature (28)..(28): Xaa can be lysine or homocitrulline
  misc_feature (42)..(42): Xaa can be lysine or homocitrulline
  misc_feature (71)..(72): Xaa can be lysine or homocitrulline
  misc_feature (87)..(87): Xaa can be lysine or homocitrulline
  misc_feature (101)..(101): Xaa can be lysine or homocitrulline
  misc_feature (108)..(108): Xaa can be lysine or homocitrulline
  misc_feature (111)..(111): Xaa can be lysine or homocitrulline
  misc_feature (139)..(140): Xaa can be lysine or homocitrulline
  misc_feature (145)..(145): Xaa can be lysine or homocitrulline
  misc_feature (160)..(160): Xaa can be lysine or homocitrulline
  misc_feature (173)..(173): Xaa can be lysine or homocitrulline
  misc_feature (260)..(260): Xaa can be lysine or homocitrulline
  misc_feature (272)..(272): Xaa can be lysine or homocitrulline
MPHSYPALSAEQXXELSDIALRIVAPGXGILAADESVGSMAXRLSQIGVENTEENRRLYRQVLFSADDRVXXCIGGVIFFHETLYQXDDNGVPFVRTIQDXGIVVGIXVDXGVVPLAGTDGETTTQGLDGLSERCAQYXXAAVYXALSDHHVYLEGTLLXPNMVTPGHACPIXYTPEEIAMATVTALRRTVPPAVPGVTFLSGGQSEEEASFNLNAINRCPLPRPWALTFSYGRALQASALNAWRGQRDNAGAATEEFIXRAEVNGLAAQGXYEGSGEDGGAAAQSLYIANHAY

SEQ ID NO: 522 - protein, 348 aa, artificial
  Concensus sequence
  misc_feature (11)..(12): Xaa can be lysine or homocitrulline
  misc_feature (25)..(25): Xaa can be lysine or homocitrulline
  misc_feature (39)..(39): Xaa can be lysine or homocitrulline
  misc_feature (81)..(81): Xaa can be lysine or homocitrulline
  misc_feature (86)..(86): Xaa can be lysine or homocitrulline
  misc_feature (92)..(92): Xaa can be lysine or homocitrulline
  misc_feature (94)..(94): Xaa can be lysine or homocitrulline
  misc_feature (101)..(101): Xaa can be lysine or homocitrulline
  misc_feature (104)..(104): Xaa can be lysine or homocitrulline
  misc_feature (132)..(133): Xaa can be lysine or homocitrulline
  misc_feature (140)..(140): Xaa can be lysine or homocitrulline
  misc_feature (146)..(146): Xaa can be lysine or homocitrulline
  misc_feature (192)..(192): Xaa can be lysine or homocitrulline
  misc_feature (200)..(200): Xaa can be lysine or homocitrulline
  misc_feature (207)..(207): Xaa can be lysine or homocitrulline
  misc_feature (222)..(222): Xaa can be lysine or homocitrulline
  misc_feature (234)..(234): Xaa can be lysine or homocitrulline
  misc_feature (280)..(280): Xaa can be lysine or homocitrulline
  misc_feature (285)..(285): Xaa can be lysine or homocitrulline
  misc_feature (307)..(308): Xaa can be lysine or homocitrulline
  misc_feature (318)..(318): Xaa can be lysine or homocitrulline
  misc_feature (329)..(329): Xaa can be lysine or homocitrulline
MPHYPALTEQXXELSDIARIVAPGXGILAADESVGSMAXRLQIGVENTEENRRYRQILFSADDRVNCIGGVILFHETLYQXDDNGXPFNIIXDXGIVVGIXVDXGVVPLAGTNGETTTQGLDGLSERCAQYXXDGADFAXWRCVLXIAETPSALAILENANVLARYASICQQNGIVPIVEPEILPDGDHDLXRCQYVTEXVLAAVYXALSDHHVYLEGTLLXPNMVTPGHACTXYTPEEIAMATVTALRRTVPPAVPGITFLSGGQSEEEASINLNAINXCPLPXPWALTFSYGRALQASALAWGGXXDNAAQEEFIXRALANLAAQGXYSGAGAAASQSLFIANHAY

SEQ ID NO: 523 - protein, 466 aa, Homo sapiens
  misc_feature (97)..(97): Xaa can be lysine or homocitrulline
  misc_feature (104)..(104): Xaa can be lysine or homocitrulline
  misc_feature (120)..(120): Xaa can be lysine or homocitrulline
  misc_feature (129)..(129): Xaa can be lysine or homocitrulline
  misc_feature (139)..(139): Xaa can be lysine or homocitrulline
  misc_feature (143)..(143): Xaa can be lysine or homocitrulline
  misc_feature (168)..(168): Xaa can be lysine or homocitrulline
  misc_feature (188)..(188): Xaa can be lysine or homocitrulline
  misc_feature (223)..(223): Xaa can be lysine or homocitrulline
  misc_feature (235)..(236): Xaa can be lysine or homocitrulline
  misc_feature (262)..(262): Xaa can be lysine or homocitrulline
  misc_feature (282)..(282): Xaa can be lysine or homocitrulline
  misc_feature (292)..(292): Xaa can be lysine or homocitrulline
  misc_feature (294)..(294): Xaa can be lysine or homocitrulline
  misc_feature (313)..(313): Xaa can be lysine or homocitrulline
  misc_feature (334)..(334): Xaa can be lysine or homocitrulline
  misc_feature (373)..(373): Xaa can be lysine or homocitrulline
  misc_feature (390)..(390): Xaa can be lysine or homocitrulline
  misc_feature (402)..(402): Xaa can be lysine or homocitrulline
  misc_feature (439)..(439): Xaa can be lysine or homocitrulline
  misc_feature (445)..(445): Xaa can be lysine or homocitrulline
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFXNTRTNEXVELQELNDRFANYIDXVRFLEQQNXILLAELEQLXGQGXSRLGDLYEEEMRELRRQVDQLTNDXARVEVERDNLAEDIMRLREXLQEEMLQREEAENTLQSFRQDVDNASLARLDLERXVESLQEEIAFLXXLHEEEIQELQAQIQEQHVQIDVDVSXPDLTAALRDVRQQYESVAAXNLQEAEEWYXSXFADLSEAANRNNDALRQAXQESTEYRRQVQSLTCEVDALXGTNESLERQMREMEENFAVEAANYQDTIGRLQDEIQNMXEEMARHLREYQDLLNVXMALDIEIATYRXLLEGEESRISLPLPNFSSLNLRETNLDSLPLVDTHSXRTLLIXTVETRDGQVINETSQHHDDLE

SEQ ID NO: 524 - protein, 483 aa, Homo sapiens
  misc_feature (8)..(8): Xaa can be lysine or homocitrulline
  misc_feature (11)..(11): Xaa can be lysine or homocitrulline
  misc_feature (92)..(92): Xaa can be lysine or homocitrulline
  misc_feature (96)..(96): Xaa can be lysine or homocitrulline
  misc_feature (101)..(101): Xaa can be lysine or homocitrulline
  misc_feature (108)..(108): Xaa can be lysine or homocitrulline
  misc_feature (117)..(117): Xaa can be lysine or homocitrulline
  misc_feature (122)..(122): Xaa can be lysine or homocitrulline
  misc_feature (130)..(130): Xaa can be lysine or homocitrulline
  misc_feature (158)..(158): Xaa can be lysine or homocitrulline
  misc_feature (160)..(160): Xaa can be lysine or homocitrulline
  misc_feature (176)..(176): Xaa can be lysine or homocitrulline
  misc_feature (178)..(178): Xaa can be lysine or homocitrulline
  misc_feature (185)..(185): Xaa can be lysine or homocitrulline
  misc_feature (197)..(198): Xaa can be lysine or homocitrulline
  misc_feature (207)..(207): Xaa can be lysine or homocitrulline
  misc_feature (264)..(264): Xaa can be lysine or homocitrulline
  misc_feature (285)..(285): Xaa can be lysine or homocitrulline
  misc_feature (295)..(295): Xaa can be lysine or homocitrulline
  misc_feature (304)..(304): Xaa can be lysine or homocitrulline
  misc_feature (325)..(325): Xaa can be lysine or homocitrulline
  misc_feature (347)..(347): Xaa can be lysine or homocitrulline
  misc_feature (352)..(352): Xaa can be lysine or homocitrulline
  misc_feature (364)..(364): Xaa can be lysine or homocitrulline
  misc_feature (381)..(381): Xaa can be lysine or homocitrulline
  misc_feature (393)..(393): Xaa can be lysine or homocitrulline
  misc_feature (414)..(414): Xaa can be lysine or homocitrulline
  misc_feature (464)..(465): Xaa can be lysine or homocitrulline
  misc_feature (472)..(472): Xaa can be lysine or homocitrulline
  misc_feature (483)..(483): Xaa can be lysine or homocitrulline
MSIRVTQXSYXVSTSGPRAFSSRSYTSGPGSRISSSSFSRVGSSNFRGGLGGGYGGASGMGGITAVTVNQSLLSPLVLEVDPNIQAVRTQEXEQIXTLNNXFASFIDXVRFLEQQNXMLETXWSLLQQQXTARSNMDNMFESYINNLRRQLETLGQEXLXLEAELGNMQGLVEDFXNXYEDEINXRTEMENEFVLIXXDVDEAYMNXVELESRLEGLTDEINFLRQLYEEEIRELQSQISDTSVVLSMDNSRSLDMDSIIAEVXAQYEDIANRSRAEAESMYQIXYEELQSLAGXHGDDLRRTXTEISEMNRNISRLQAEIEGLXGQRASLEAAIADAEQRGELAIXDANAXLSELEAALQRAXQDMARQLREYQELMNVXLALDIEIATYRXLLEGEESRLESGMQNMSIHTXTTSGYAGGLSSAYGGLTSPGLSYSLGSSFGSGAGSSSFSRTSSSRAVVVXXIETRDGXLVSESSDVLPX

SEQ ID NO: 525 - protein, 654 aa, Homo sapiens
  misc_feature (2)..(2): Xaa can be lysine or homocitrulline
  misc_feature (23)..(24): Xaa can be lysine or homocitrulline
  misc_feature (46)..(46): Xaa can be lysine or homocitrulline
  misc_feature (81)..(81): Xaa can be lysine or homocitrulline
  misc_feature (96)..(96): Xaa can be lysine or homocitrulline
  misc_feature (113)..(113): Xaa can be lysine or homocitrulline
  misc_feature (118)..(118): Xaa can be lysine or homocitrulline
  misc_feature (122)..(123): Xaa can be lysine or homocitrulline
  misc_feature (125)..(125): Xaa can be lysine or homocitrulline
  misc_feature (138)..(138): Xaa can be lysine or homocitrulline
  misc_feature (152)..(152): Xaa can be lysine or homocitrulline
  misc_feature (154)..(154): Xaa can be lysine or homocitrulline
  misc_feature (163)..(164): Xaa can be lysine or homocitrulline
  misc_feature (185)..(185): Xaa can be lysine or homocitrulline
  misc_feature (213)..(213): Xaa can be lysine or homocitrulline
  misc_feature (218)..(218): Xaa can be lysine or homocitrulline
  misc_feature (268)..(268): Xaa can be lysine or homocitrulline
  misc_feature (271)..(273): Xaa can be lysine or homocitrulline
  misc_feature (276)..(276): Xaa can be lysine or homocitrulline
  misc_feature (280)..(280): Xaa can be lysine or homocitrulline
  misc_feature (287)..(287): Xaa can be lysine or homocitrulline
  misc_feature (294)..(294): Xaa can be lysine or homocitrulline
  misc_feature (296)..(296): Xaa can be lysine or homocitrulline
  misc_feature (326)..(326): Xaa can be lysine or homocitrulline
  misc_feature (340)..(340): Xaa can be lysine or homocitrulline
  misc_feature (344)..(344): Xaa can be lysine or homocitrulline
  misc_feature (352)..(353): Xaa can be lysine or homocitrulline
  misc_feature (370)..(370): Xaa can be lysine or homocitrulline
  misc_feature (376)..(376): Xaa can be lysine or homocitrulline
  misc_feature (382)..(382): Xaa can be lysine or homocitrulline
  misc_feature (435)..(435): Xaa can be lysine or homocitrulline
  misc_feature (446)..(447): Xaa can be lysine or homocitrulline
  misc_feature (464)..(464): Xaa can be lysine or homocitrulline
  misc_feature (474)..(474): Xaa can be lysine or homocitrulline
  misc_feature (516)..(516): Xaa can be lysine or homocitrulline
  misc_feature (521)..(521): Xaa can be lysine or homocitrulline
  misc_feature (523)..(523): Xaa can be lysine or homocitrulline
  misc_feature (547)..(547): Xaa can be lysine or homocitrulline
  misc_feature (553)..(554): Xaa can be lysine or homocitrulline
  misc_feature (556)..(556): Xaa can be lysine or homocitrulline
  misc_feature (573)..(573): Xaa can be lysine or homocitrulline
  misc_feature (579)..(579): Xaa can be lysine or homocitrulline
  misc_feature (581)..(581): Xaa can be lysine or homocitrulline
  misc_feature (585)..(585): Xaa can be lysine or homocitrulline
  misc_feature (591)..(591): Xaa can be lysine or homocitrulline
  misc_feature (596)..(596): Xaa can be lysine or homocitrulline
  misc_feature (601)..(601): Xaa can be lysine or homocitrulline
  misc_feature (617)..(617): Xaa can be lysine or homocitrulline
  misc_feature (619)..(621): Xaa can be lysine or homocitrulline
  misc_feature (633)..(633): Xaa can be lysine or homocitrulline
  misc_feature (651)..(651): Xaa can be lysine or homocitrulline
MXLSLVAAMLLLLSAARAEEEDXXEDVGTVVGIDLGTTYSCVGVFXNGRVEIIANDQGNRITPSYVAFTPEGERLIGDAAXNQLTSNPENTVFDAXRLIGRTWNDPSVQQDIXFLPFXVVEXXTXPYIQVDIGGGQTXTFAPEEISAMVLTXMXETAEAYLGXXVTHAVVTVPAYFNDAQRQATXDAGTIAGLNVMRIINEPTAAAIAYGLDXREGEXNILVFDLGGGTFDVSLLTIDNGVFEVVATNGDTHLGGEDFDQRVMEHFIXLYXXXTGXDVRXDNRAVQXLRREVEXAXRALSSQHQARIEIESFYEGEDFSETLTRAXFEELNMDLFRSTMXPVQXVLEDSDLXXSDIDEIVLVGGSTRIPXIQQLVXEFFNGXEPSRGINPDEAVAYGAAVQAGVLSGDQDTGDLVLLDVCPLTLGIETVGGVMTXLIPRNTVVPTXXSQIFSTASDNQPTVTIXVYEGERPLTXDNHLLGTFDLTGIPPAPRGVPQIEVTFEIDVNGILRVTAEDXGTGNXNXITITNDQNRLTPEEIERMVNDAEXFAEEDXXLXERIDTRNELESYAYSLXNQIGDXEXLGGXLSSEDXETMEXAVEEXIEWLESHQDADIEDFXAXXXELEEIVQPIISXLYGSAGPPPTGEEDTAEXDEL

SEQ ID NO: 526 - protein, 294 aa, Homo sapiens
  misc_feature (24)..(24): Xaa can be lysine or homocitrulline
  misc_feature (27)..(27): Xaa can be lysine or homocitrulline
  misc_feature (32)..(32): Xaa can be lysine or homocitrulline
  misc_feature (54)..(54): Xaa can be lysine or homocitrulline
  misc_feature (73)..(73): Xaa can be lysine or homocitrulline
  misc_feature (80)..(80): Xaa can be lysine or homocitrulline
  misc_feature (103)..(103): Xaa can be lysine or homocitrulline
  misc_feature (134)..(134): Xaa can be lysine or homocitrulline
  misc_feature (141)..(141): Xaa can be lysine or homocitrulline
  misc_feature (150)..(150): Xaa can be lysine or homocitrulline
  misc_feature (154)..(155): Xaa can be lysine or homocitrulline
  misc_feature (157)..(157): Xaa can be lysine or homocitrulline
  misc_feature (189)..(189): Xaa can be lysine or homocitrulline
  misc_feature (193)..(194): Xaa can be lysine or homocitrulline
  misc_feature (202)..(202): Xaa can be lysine or homocitrulline
  misc_feature (206)..(206): Xaa can be lysine or homocitrulline
  misc_feature (212)..(212): Xaa can be lysine or homocitrulline
  misc_feature (215)..(215): Xaa can be lysine or homocitrulline
  misc_feature (223)..(223): Xaa can be lysine or homocitrulline
  misc_feature (229)..(230): Xaa can be lysine or homocitrulline
  misc_feature (233)..(233): Xaa can be lysine or homocitrulline
  misc_feature (236)..(236): Xaa can be lysine or homocitrulline
  misc_feature (239)..(239): Xaa can be lysine or homocitrulline
  misc_feature (248)..(248): Xaa can be lysine or homocitrulline
  misc_feature (250)..(250): Xaa can be lysine or homocitrulline
  misc_feature (257)..(257): Xaa can be lysine or homocitrulline
  misc_feature (263)..(263): Xaa can be lysine or homocitrulline
  misc_feature (267)..(267): Xaa can be lysine or homocitrulline
  misc_feature (273)..(273): Xaa can be lysine or homocitrulline
  misc_feature (292)..(292): Xaa can be lysine or homocitrulline
MEDSMDMDMSPLRPQNYLFGCELXADXDYHFXVDNDENEHQLSLRTVSLGAGAXDELHIVEAEAMNYEGSPIXVTLATLXMSVQPTVSLGGFEITPPVVLRLXCGSGPVHISGQHLVAVEEDAESEDEEEEDVXLLSISGXRSAPGGGSXVPQXXVXLAADEDDDDDDEEDDDEDDDDDDFDDEEAEEXAPVXXSIRDTPAXNAQXSNQNGXDSXPSSTPRSXGQESFXXQEXTPXTPXGPSSVEDIXAXMQASIEXGGSLPXVEAXFINYVXNCFRMTDQEAIQDLWQWRXSL

SEQ ID NO: 527 - protein, 434 aa, Homo sapiens
  misc_feature (5)..(5): Xaa can be lysine or homocitrulline
  misc_feature (28)..(28): Xaa can be lysine or homocitrulline
  misc_feature (54)..(54): Xaa can be lysine or homocitrulline
  misc_feature (60)..(60): Xaa can be lysine or homocitrulline
  misc_feature (64)..(64): Xaa can be lysine or homocitrulline
  misc_feature (71)..(71): Xaa can be lysine or homocitrulline
  misc_feature (80)..(81): Xaa can be lysine or homocitrulline
  misc_feature (89)..(89): Xaa can be lysine or homocitrulline
  misc_feature (92)..(92): Xaa can be lysine or homocitrulline
  misc_feature (103)..(103): Xaa can be lysine or homocitrulline
  misc_feature (105)..(105): Xaa can be lysine or homocitrulline
  misc_feature (120)..(120): Xaa can be lysine or homocitrulline
  misc_feature (126)..(126): Xaa can be lysine or homocitrulline
  misc_feature (162)..(162): Xaa can be lysine or homocitrulline
  misc_feature (193)..(193): Xaa can be lysine or homocitrulline
  misc_feature (197)..(197): Xaa can be lysine or homocitrulline
  misc_feature (199)..(199): Xaa can be lysine or homocitrulline
  misc_feature (202)..(202): Xaa can be lysine or homocitrulline
  misc_feature (221)..(221): Xaa can be lysine or homocitrulline
  misc_feature (228)..(228): Xaa can be lysine or homocitrulline
  misc_feature (233)..(233): Xaa can be lysine or homocitrulline
  misc_feature (239)..(239): Xaa can be lysine or homocitrulline
  misc_feature (256)..(256): Xaa can be lysine or homocitrulline
  misc_feature (262)..(262): Xaa can be lysine or homocitrulline
  misc_feature (281)..(281): Xaa can be lysine or homocitrulline
  misc_feature (285)..(285): Xaa can be lysine or homocitrulline
  misc_feature (306)..(306): Xaa can be lysine or homocitrulline
  misc_feature (326)..(326): Xaa can be lysine or homocitrulline
  misc_feature (330)..(330): Xaa can be lysine or homocitrulline
  misc_feature (335)..(335): Xaa can be lysine or homocitrulline
  misc_feature (343)..(343): Xaa can be lysine or homocitrulline
  misc_feature (358)..(358): Xaa can be lysine or homocitrulline
  misc_feature (394)..(394): Xaa can be lysine or homocitrulline
  misc_feature (406)..(406): Xaa can be lysine or homocitrulline
  misc_feature (420)..(420): Xaa can be lysine or homocitrulline
  misc_feature (422)..(422): Xaa can be lysine or homocitrulline
  misc_feature (434)..(434): Xaa can be lysine or homocitrulline
MSILXIHAREIFDSRGNPTVEVDLFTSXGLFRAAVPSGASTGIYEALELRDNDXTRYMGXGVSXAVEHINXTIAPALVSXXLNVTEQEXIDXLMIEMDGTENXSXFGANAILGVSLAVCXAGAVEXGVPLYRHIADLAGNSEVILPVPAFNVINGGSHAGNXLAMQEFMILPVGAANFREAMRIGAEVYHNLXNVIXEXYGXDATNVGDEGGFAPNILENXEGLELLXTAIGXAGYTDXVVIGMDVAASEFFRSGXYDLDFXSPDDPSRYISPDQLADLYXSFIXDYPVVSIEDPFDQDDWGAWQXFTASAGIQVVGDDLTVTNPXRIAXAVNEXSCNCLLLXVNQIGSVTESLQACXLAQANGWGVMVSHRSGETEDTFIADLVVGLCTGQIXTGAPCRSERLAXYNQLLRIEEELGSXAXFAGRNFRNPLAX

SEQ ID NO: 528 - protein, 781 aa, Homo sapiens
  misc_feature (19)..(19): Xaa can be lysine or homocitrulline
  misc_feature (49)..(49): Xaa can be lysine or homocitrulline
  misc_feature (133)..(133): Xaa can be lysine or homocitrulline
  misc_feature (158)..(158): Xaa can be lysine or homocitrulline
  misc_feature (170)..(170): Xaa can be lysine or homocitrulline
  misc_feature (180)..(181): Xaa can be lysine or homocitrulline
  misc_feature (233)..(233): Xaa can be lysine or homocitrulline
  misc_feature (242)..(242): Xaa can be lysine or homocitrulline
  misc_feature (270)..(270): Xaa can be lysine or homocitrulline
  misc_feature (281)..(281): Xaa can be lysine or homocitrulline
  misc_feature (288)..(288): Xaa can be lysine or homocitrulline
  misc_feature (292)..(292): Xaa can be lysine or homocitrulline
  misc_feature (312)..(312): Xaa can be lysine or homocitrulline
  misc_feature (335)..(335): Xaa can be lysine or homocitrulline
  misc_feature (345)..(345): Xaa can be lysine or homocitrulline
  misc_feature (354)..(354): Xaa can be lysine or homocitrulline
  misc_feature (394)..(394): Xaa can be lysine or homocitrulline
  misc_feature (433)..(433): Xaa can be lysine or homocitrulline
  misc_feature (435)..(435): Xaa can be lysine or homocitrulline
  misc_feature (496)..(496): Xaa can be lysine or homocitrulline
  misc_feature (508)..(508): Xaa can be lysine or homocitrulline
  misc_feature (625)..(625): Xaa can be lysine or homocitrulline
  misc_feature (666)..(666): Xaa can be lysine or homocitrulline
  misc_feature (671)..(672): Xaa can be lysine or homocitrulline
MATQADLMELDMAMEPDRXAAVSHWQQQSYLDSGIHSGATTTAPSLSGXGNPEEEDVDTSQVLYEWEQGFSQSFTQEQVADIDGQYAMTRAQRVRAAMFPETLDEGMQIPSTQFDAAHPTNVQRLAEPSQMLXHAVVNLINYQDDAELATRAIPELTXLLNDEDQVVVNXAAVMVHQLSXXEASRHAIMRSPQMVSAIVRTMQNTNDVETARCTAGTLHNLSHHREGLLAIFXSGGIPALVXMLGSPVDSVLFYAITTLHNLLLHQEGAXMAVRLAGGLQXMVALLNXTNVXFLAITTDCLQILAYGNQESXLIILASGGPQALVNIMRTYTYEXLLWTTSRVLXVLSVCSSNXPAIVEAGGMQALGLHLTDPSQRLVQNCLWTLRNLSDAATXQEGMEGLLGTLVQLLGSDDINVVTCAAGILSNLTCNNYXNXMMVCQVGGIEALVRTVLRAGDREDITEPAICALRHLTSRHQEAEMAQNAVRLHYGLPVVVXLLHPPSHWPLIXATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDXEAAEAIEAEGATAPLTELLHSRNEGVATYAAAVLFRMSEDXPQDYXXRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 529 - protein, 573 aa, Homo sapiens
  misc_feature (28)..(28): Xaa can be lysine or homocitrulline
  misc_feature (31)..(31): Xaa can be lysine or homocitrulline
  misc_feature (58)..(58): Xaa can be lysine or homocitrulline
  misc_feature (72)..(72): Xaa can be lysine or homocitrulline
  misc_feature (75)..(75): Xaa can be lysine or homocitrulline
  misc_feature (82)..(82): Xaa can be lysine or homocitrulline
  misc_feature (87)..(87): Xaa can be lysine or homocitrulline
  misc_feature (89)..(89): Xaa can be lysine or homocitrulline
  misc_feature (91)..(91): Xaa can be lysine or homocitrulline
  misc_feature (96)..(96): Xaa can be lysine or homocitrulline
  misc_feature (125)..(125): Xaa can be lysine or homocitrulline
  misc_feature (130)..(130): Xaa can be lysine or homocitrulline
  misc_feature (133)..(133): Xaa can be lysine or homocitrulline
  misc_feature (156)..(157): Xaa can be lysine or homocitrulline
  misc_feature (160)..(160): Xaa can be lysine or homocitrulline
  misc_feature (180)..(180): Xaa can be lysine or homocitrulline
  misc_feature (191)..(192): Xaa can be lysine or homocitrulline
  misc_feature (196)..(196): Xaa can be lysine or homocitrulline
  misc_feature (202)..(202): Xaa can be lysine or homocitrulline
  misc_feature (205)..(205): Xaa can be lysine or homocitrulline
  misc_feature (218)..(218): Xaa can be lysine or homocitrulline
  misc_feature (233)..(233): Xaa can be lysine or homocitrulline
  misc_feature (236)..(236): Xaa can be lysine or homocitrulline
  misc_feature (249)..(250): Xaa can be lysine or homocitrulline
  misc_feature (269)..(269): Xaa can be lysine or homocitrulline
  misc_feature (292)..(292): Xaa can be lysine or homocitrulline
  misc_feature (301)..(301): Xaa can be lysine or homocitrulline
  misc_feature (310)..(310): Xaa can be lysine or homocitrulline
  misc_feature (314)..(314): Xaa can be lysine or homocitrulline
  misc_feature (344)..(344): Xaa can be lysine or homocitrulline
  misc_feature (352)..(352): Xaa can be lysine or homocitrulline
  misc_feature (359)..(359): Xaa can be lysine or homocitrulline
  misc_feature (361)..(361): Xaa can be lysine or homocitrulline
  misc_feature (364)..(364): Xaa can be lysine or homocitrulline
  misc_feature (369)..(369): Xaa can be lysine or homocitrulline
  misc_feature (387)..(387): Xaa can be lysine or homocitrulline
  misc_feature (389)..(389): Xaa can be lysine or homocitrulline
  misc_feature (396)..(396): Xaa can be lysine or homocitrulline
  misc_feature (405)..(405): Xaa can be lysine or homocitrulline
  misc_feature (417)..(418): Xaa can be lysine or homocitrulline
  misc_feature (462)..(462): Xaa can be lysine or homocitrulline
  misc_feature (469)..(469): Xaa can be lysine or homocitrulline
  misc_feature (473)..(473): Xaa can be lysine or homocitrulline
  misc_feature (481)..(481): Xaa can be lysine or homocitrulline
  misc_feature (493)..(493): Xaa can be lysine or homocitrulline
  misc_feature (516)..(516): Xaa can be lysine or homocitrulline
  misc_feature (523)..(523): Xaa can be lysine or homocitrulline
  misc_feature (551)..(551): Xaa can be lysine or homocitrulline
  misc_feature (554)..(554): Xaa can be lysine or homocitrulline
MLRLPTVFRQMRPVSRVLAPHLTRAYAXDVXFGADARALMLQGVDLLADAVAVTMGPXGRTVIIEQSWGSPXVTXDGVTVAXSIDLXDXYXNIGAXLVQDVANNTNEEAGDGTTTATVLARSIAXEGFEXISXGANPVEIRRGVMLAVDAVIAELXXQSXPVTTPEEIAQVATISANGDXEIGNIISDAMXXVGRXGVITVXDGXTLNDELEIIEGMXFDRGYISPYFINTSXGQXCEFQDAYVLLSEXXISSIQSIVPALEIANAHRXPLVIIAEDVDGEALSTLVLNRLXVGLQVVAVXAPGFGDNRXNQLXDMAIATGGAVFGEEGLTLNLEDVQPHDLGXVGEVIVTXDDAMLLXGXGDXAQIEXRIQEIIEQLDVTTSEYEXEXLNERLAXLSDGVAVLXVGGTSDVEVNEXXDRVTDALNATRAAVEEGIVLGGGCALLRCIPALDSLTPANEDQXIGIEIIXRTLXIPAMTIAXNAGVEGSLIVEXIMQSSSEVGYDAMAGDFVNMVEXGIIDPTXVVRTALLDAAGVASLLTTAEVVVTEIPXEEXDPGMGAMGGMGGGMGGGMF

SEQ ID NO: 530 - protein, 23 aa, Homo sapiens
  misc_feature (19)..(19): Xaa can be lysine or homocitrulline
FSLADAINTEFRNTRTNEXVELQ

SEQ ID NO: 531 - protein, 23 aa, gallus gallus
  misc_feature (12)..(12): Xaa can be lysine or homocitrulline
  misc_feature (19)..(19): Xaa can be lysine or homocitrulline
FTLADAINTEFXANRTNEXVELQ

SEQ ID NO: 532 - protein, 20 aa, gallus gallus
  misc_feature (2)..(2): Xaa can be lysine or homocitrulline
  misc_feature (9)..(9): Xaa can be lysine or homocitrulline
FXANRTNEXVELQELNDRFA

SEQ ID NO: 533 - protein, 20 aa, oryctolagus cuniculus
  misc_feature (9)..(9): Xaa can be lysine or homocitrulline
FRNTRTNEXVELQELNDRFA

SEQ ID NO: 534 - protein, 22 aa, Homo sapiens
  misc_feature (4)..(4): Xaa can be lysine or homocitrulline
  misc_feature (20)..(20): Xaa can be lysine or homocitrulline
TNEXVELQELNDRFASYIDXVR

SEQ ID NO: 535 - protein, 20 aa, equus caballus
  misc_feature (5)..(5): Xaa can be lysine or homocitrulline
  misc_feature (14)..(14): Xaa can be lysine or homocitrulline
SYIDXVRFLEQQNXILLAEL

SEQ ID NO: 536 - protein, 15 aa, Homo sapiens
  misc_feature (1)..(1): Xaa can be lysine or homocitrulline
  misc_feature (10)..(10): Xaa can be lysine or homocitrulline
XVRFLEQQNXILLAE

SEQ ID NO: 537 - protein, 21 aa, gallus gallus
  misc_feature (21)..(21): Xaa can be lysine or homocitrulline
LAGLDLERPVESLQEEIVFLX

SEQ ID NO: 538 - protein, 21 aa, Homo sapiens
  misc_feature (8)..(8): Xaa can be lysine or homocitrulline
QIDMDVSXPDLTAALRDVRQQ

SEQ ID NO: 539 - protein, 21 aa, ovis aries
QIDMDVSQPDLTAALRDVRQQ

SEQ ID NO: 540 - protein, 20 aa, Homo sapiens
  misc_feature (14)..(14): Xaa can be lysine or homocitrulline
IGGVILFHETLYQXTDDGRP

SEQ ID NO: 541 - protein, 19 aa, Homo sapiens
  misc_feature (3)..(3): Xaa can be lysine or homocitrulline
  misc_feature (11)..(11): Xaa can be lysine or homocitrulline
DLXRCQYVTEXVLAAVYRA

SEQ ID NO: 542 - protein, 19 aa, Homo sapiens
  misc_feature (1)..(1): Xaa can be lysine or homocitrulline
XVLAAVYRALSDHHVYLEG

SEQ ID NO: 543 - protein, 19 aa, Homo sapiens
  misc_feature (6)..(6): Xaa can be lysine or homocitrulline
HACTQXYSHEEIAMATVTA

SEQ ID NO: 544 - protein, 19 aa, equus caballus
  misc_feature (6)..(6): Xaa can be lysine or homocitrulline
HACTHXYSHEEIAMATVTA

SEQ ID NO: 545 - protein, 20 aa, Homo sapiens
  misc_feature (8)..(8): Xaa can be lysine or homocitrulline
  misc_feature (20)..(20): Xaa can be lysine or homocitrulline
AAQEEYIXRALANSLACQGX

SEQ ID NO: 546 - protein, 16 aa, Homo sapiens
  misc_feature (5)..(5): Xaa can be lysine or homocitrulline
MSILXVHAREIFDSRG

SEQ ID NO: 547 - protein, 16 aa, murine
MSILRIHAREIFDSRG

SEQ ID NO: 548 - protein, 16 aa, oryctolagus cuniculus
  misc_feature (5)..(5): Xaa can be lysine or homocitrulline
MSVLXVHAREIFDSRG

SEQ ID NO: 549 - protein, 18 aa, Homo sapiens
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRFMGXGVSXAVEHI

SEQ ID NO: 550 - protein, 18 aa, murine
  misc_feature (3)..(3): Xaa can be lysine or homocitrulline
  misc_feature (9)..(9): Xaa can be lysine or homocitrulline
NDXTRFMGXGVSQAVEHI

SEQ ID NO: 551 - protein, 18 aa, gallus gallus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYLGXGVSXAVEHV

SEQ ID NO: 552 - protein, 21 aa, Homo sapiens
  misc_feature (7)..(7): Xaa can be lysine or homocitrulline
GSHAGNXLAMQEFMILPIGAA

SEQ ID NO: 553 - protein, 21 aa, murine
  misc_feature (7)..(7): Xaa can be lysine or homocitrulline
GSHAGNXLAMQEFMILPVGAS

SEQ ID NO: 554 - protein, 21 aa, sus scrofa
  misc_feature (7)..(7): Xaa can be lysine or homocitrulline
GSHAGNXLAMQEFMILPVGAE

SEQ ID NO: 555 - protein, 21 aa, gallus gallus
  misc_feature (7)..(7): Xaa can be lysine or homocitrulline
GSHAGNXLAMQEFMILPVGAD

SEQ ID NO: 556 - protein, 22 aa, canis lupus
  misc_feature (13)..(13): Xaa can be lysine or homocitrulline
CSHTRNSLRGETXFSIWPSAGG

SEQ ID NO: 557 - protein, 19 aa, equus caballus
  misc_feature (15)..(15): Xaa can be lysine or homocitrulline
  misc_feature (19)..(19): Xaa can be lysine or homocitrulline
SEAMRIGAEVYHNLXNVIX

SEQ ID NO: 558 - protein, 19 aa, gallus gallus
  misc_feature (1)..(1): Xaa can be lysine or homocitrulline
  misc_feature (15)..(15): Xaa can be lysine or homocitrulline
  misc_feature (19)..(19): Xaa can be lysine or homocitrulline
XEAMRIGAEVYHNLXNVIX

SEQ ID NO: 559 - protein, 26 aa, canis lupus
  misc_feature (9)..(9): Xaa can be lysine or homocitrulline
  misc_feature (16)..(16): Xaa can be lysine or homocitrulline
  misc_feature (18)..(18): Xaa can be lysine or homocitrulline
QQVLAPMRXEVLDSSXRXLGSEYLVV

SEQ ID NO: 560 - protein, 25 aa, canis lupus
  misc_feature (2)..(2): Xaa can be lysine or homocitrulline
  misc_feature (22)..(22): Xaa can be lysine or homocitrulline
RXLGSEYLVVILLELPIWQLLXGTF

SEQ ID NO: 561 - protein, 20 aa, Homo sapiens
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 562 - protein, 20 aa, rattus rattus
  misc_feature (12)..(12): Xaa can be lysine or homocitrulline
  misc_feature (18)..(18): Xaa can be lysine or homocitrulline
DVAASEFYRAGXYDLDFXSP

SEQ ID NO: 563 - protein, 20 aa, gallus gallus
  misc_feature (12)..(12): Xaa can be lysine or homocitrulline
  misc_feature (18)..(18): Xaa can be lysine or homocitrulline
DVAASEFYRDGXYDLDFXSP

SEQ ID NO: 564 - protein, 19 aa, murine
  misc_feature (9)..(9): Xaa can be lysine or homocitrulline
PDQLADLYXSFVQNYPVVS

SEQ ID NO: 565 - protein, 19 aa, bos taurus
  misc_feature (9)..(9): Xaa can be lysine or homocitrulline
PDELANLYXSFIRDYPVVS

SEQ ID NO: 566 - protein, 19 aa, sus scrofa
  misc_feature (9)..(9): Xaa can be lysine or homocitrulline
PDQLADLYXSFIRDYPVVS

SEQ ID NO: 567 - protein, 19 aa, equus caballus
  misc_feature (9)..(9): Xaa can be lysine or homocitrulline
  misc_feature (13)..(13): Xaa can be lysine or homocitrulline
PDELANLYXSFIXDYPVVS

SEQ ID NO: 568 - protein, 19 aa, gallus gallus
  misc_feature (13)..(13): Xaa can be lysine or homocitrulline
PDQLADLYLGFVXNYPVVS

SEQ ID NO: 569 - protein, 19 aa, oryctolagus cuniculus
  misc_feature (9)..(9): Xaa can be lysine or homocitrulline
PDQLADLYXSFVRDYPVVS

SEQ ID NO: 570 - protein, 19 aa, ovis aries
  misc_feature (9)..(9): Xaa can be lysine or homocitrulline
PDELADLYXSFIRDYPVVS

SEQ ID NO: 571 - protein, 17 aa, rattus rattus
  misc_feature (6)..(6): Xaa can be lysine or homocitrulline
WDAWQXFTATAGIQVVG

SEQ ID NO: 572 - protein, 17 aa, bos taurus
  misc_feature (6)..(6): Xaa can be lysine or homocitrulline
WEAWQXFTASAGIQVVG

SEQ ID NO: 573 - protein, 17 aa, sus scrofa
  misc_feature (6)..(6): Xaa can be lysine or homocitrulline
WEAWQXFTGSAGIQVVG

SEQ ID NO: 574 - protein, 17 aa, gallus gallus
  misc_feature (5)..(6): Xaa can be lysine or homocitrulline
WAAWXXFTASVGIQVVG

SEQ ID NO: 575 - protein, 20 aa, murine
  misc_feature (3)..(3): Xaa can be lysine or homocitrulline
  misc_feature (11)..(11): Xaa can be lysine or homocitrulline
SEXSCNCLLLXVNQIGSVTE

SEQ ID NO: 576 - protein, 20 aa, rattus rattus
  misc_feature (3)..(3): Xaa can be lysine or homocitrulline
  misc_feature (11)..(11): Xaa can be lysine or homocitrulline
GEXSCNCLLLXVNQIGSVTE

SEQ ID NO: 577 - protein, 20 aa, sus scrofa
  misc_feature (3)..(3): Xaa can be lysine or homocitrulline
  misc_feature (11)..(11): Xaa can be lysine or homocitrulline
AEXSCNCLLLXVNQIGSVTE

SEQ ID NO: 578 - protein, 20 aa, gallus gallus
  misc_feature (3)..(3): Xaa can be lysine or homocitrulline
  misc_feature (11)..(11): Xaa can be lysine or homocitrulline
EEXSCNCLLLXVNQIGSVTE

SEQ ID NO: 579 - protein, 20 aa, felis catus
  misc_feature (11)..(11): Xaa can be lysine or homocitrulline
NERSCNCLLLXVNQIGSVTE

SEQ ID NO: 580 - protein, 20 aa, oryctolagus cuniculus
  misc_feature (3)..(3): Xaa can be lysine or homocitrulline
  misc_feature (11)..(11): Xaa can be lysine or homocitrulline
DQXSCNCLLLXVNQIGSVTE

SEQ ID NO: 581 - protein, 19 aa, Homo sapiens
  misc_feature (2)..(2): Xaa can be lysine or homocitrulline
  misc_feature (10)..(10): Xaa can be lysine or homocitrulline
EXSCNCLLLXVNQIGSVTE

SEQ ID NO: 582 - protein, 20 aa, murine
  misc_feature (7)..(7): Xaa can be lysine or homocitrulline
RSERLAXYNQILRIEEELGS

SEQ ID NO: 583 - protein, 17 aa, murine
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 584 - protein, 17 aa, gallus gallus
  misc_feature (3)..(3): Xaa can be lysine or homocitrulline
GSXARFAGRNFRNPRIN

SEQ ID NO: 585 - protein, 17 aa, ovis aries
  misc_feature (3)..(3): Xaa can be lysine or homocitrulline
  misc_feature (5)..(5): Xaa can be lysine or homocitrulline
GSXAXFAGRSFRSGRRA

SEQ ID NO: 586 - protein, 21 aa, gallus gallus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXYLPFXVVEXXA

SEQ ID NO: 587 - protein, 20 aa, murine
  misc_feature (1)..(2): Xaa can be lysine or homocitrulline
  misc_feature (14)..(14): Xaa can be lysine or homocitrulline
XXELEEIVQPIISXLYGSGG

SEQ ID NO: 588 - protein, 20 aa, gallus gallus
  misc_feature (1)..(2): Xaa can be lysine or homocitrulline
  misc_feature (14)..(14): Xaa can be lysine or homocitrulline
XXELEEVVQPIVSXLYGSAG

SEQ ID NO: 589 - protein, 20 aa, Homo sapiens
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRFL

SEQ ID NO: 590 - protein, 20 aa, bos taurus
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRHL

SEQ ID NO: 591 - protein, 20 aa, gallus gallus
  misc_feature (4)..(4): Xaa can be lysine or homocitrulline
  misc_feature (16)..(16): Xaa can be lysine or homocitrulline
EQIXTLNNRFASFIDXVRFL

SEQ ID NO: 592 - protein, 20 aa, felis catus
  misc_feature (4)..(4): Xaa can be lysine or homocitrulline
  misc_feature (16)..(16): Xaa can be lysine or homocitrulline
EQIXTLNNRFASFIDXVRHL

SEQ ID NO: 593 - protein, 20 aa, canis lupus
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXSLNNXFASFIDXVRHL

SEQ ID NO: 594 - protein, 20 aa, bos taurus
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXVLE

SEQ ID NO: 595 - protein, 20 aa, equus caballus
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXILE

SEQ ID NO: 596 - protein, 20 aa, gallus gallus
  misc_feature (8)..(8): Xaa can be lysine or homocitrulline
  misc_feature (17)..(17): Xaa can be lysine or homocitrulline
RFASFIDXVRFLEQQNXMLE

SEQ ID NO: 597 - protein, 20 aa, felis catus
  misc_feature (8)..(8): Xaa can be lysine or homocitrulline
  misc_feature (17)..(17): Xaa can be lysine or homocitrulline
RFASFIDXVRHLEQQNXILE

SEQ ID NO: 598 - protein, 20 aa, artificial
  Concensus sequence
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXMLE

SEQ ID NO: 599 - protein, 20 aa, bos taurus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXVLETXWNLLQQQXT

SEQ ID NO: 600 - protein, 20 aa, equus caballus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXILETXWSFLQQQXT

SEQ ID NO: 601 - protein, 20 aa, gallus gallus
  misc_feature (6)..(6): Xaa can be lysine or homocitrulline
  misc_feature (11)..(11): Xaa can be lysine or homocitrulline
LEQQNXMLETXWSLLQSQQP

SEQ ID NO: 602 - protein, 20 aa, felis catus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXILETXWNLLQQQXT

SEQ ID NO: 603 - protein, 20 aa, canis lupus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXILETXWSLLQQQXT

SEQ ID NO: 604 - protein, 21 aa, murine
  misc_feature (3)..(3): Xaa can be lysine or homocitrulline
  misc_feature (11)..(11): Xaa can be lysine or homocitrulline
ETXWSLLQQQXTSRSNMDNMF

SEQ ID NO: 605 - protein, 21 aa, bos taurus
  misc_feature (3)..(3): Xaa can be lysine or homocitrulline
  misc_feature (11)..(11): Xaa can be lysine or homocitrulline
ETXWNLLQQQXTARSNIDNMF

SEQ ID NO: 606 - protein, 21 aa, equus caballus
  misc_feature (3)..(3): Xaa can be lysine or homocitrulline
  misc_feature (11)..(11): Xaa can be lysine or homocitrulline
ETXWSFLQQQXTARSNMDNMF

SEQ ID NO: 607 - protein, 21 aa, gallus gallus
  misc_feature (3)..(3): Xaa can be lysine or homocitrulline
ETXWSLLQSQQPQRSDLRGLF

SEQ ID NO: 608 - protein, 21 aa, felis catus
  misc_feature (3)..(3): Xaa can be lysine or homocitrulline
  misc_feature (11)..(11): Xaa can be lysine or homocitrulline
ETXWNLLQQQXTARSNMDNMF

SEQ ID NO: 609 - protein, 21 aa, canis lupus
  misc_feature (3)..(3): Xaa can be lysine or homocitrulline
  misc_feature (11)..(11): Xaa can be lysine or homocitrulline
ETXWSLLQQQXTSRSNIDNMF

SEQ ID NO: 610 - protein, 21 aa, bos taurus
  misc_feature (4)..(4): Xaa can be lysine or homocitrulline
  misc_feature (16)..(17): Xaa can be lysine or homocitrulline
EIQXRTDMENEFVIIXXDVDE

SEQ ID NO: 611 - protein, 21 aa, equus caballus
  misc_feature (4)..(4): Xaa can be lysine or homocitrulline
  misc_feature (8)..(8): Xaa can be lysine or homocitrulline
  misc_feature (16)..(17): Xaa can be lysine or homocitrulline
EINXRTEXENEFVLIXXDVDE

SEQ ID NO: 612 - protein, 21 aa, gallus gallus
  misc_feature (8)..(8): Xaa can be lysine or homocitrulline
  misc_feature (16)..(17): Xaa can be lysine or homocitrulline
EINHRTEXENEFVLLXXDVDE

SEQ ID NO: 613 - protein, 21 aa, felis catus
  misc_feature (3)..(3): Xaa can be lysine or homocitrulline
  misc_feature (16)..(17): Xaa can be lysine or homocitrulline
EIXERADMENEFVLIXXDVDE

SEQ ID NO: 614 - protein, 21 aa, canis lupus
  misc_feature (3)..(3): Xaa can be lysine or homocitrulline
  misc_feature (16)..(17): Xaa can be lysine or homocitrulline
EIXLRGDMENEFVLIXXDVDE

SEQ ID NO: 615 - protein, 19 aa, ovis aries
  misc_feature (8)..(9): Xaa can be lysine or homocitrulline
  misc_feature (18)..(18): Xaa can be lysine or homocitrulline
ENEFVIIXXDVDEAYMNXV

SEQ ID NO: 616 - protein, 19 aa, gallus gallus
  misc_feature (8)..(9): Xaa can be lysine or homocitrulline
  misc_feature (18)..(18): Xaa can be lysine or homocitrulline
ENEFVLLXXDVDEAYMSXV

SEQ ID NO: 617 - protein, 19 aa, canis lupus
  misc_feature (8)..(9): Xaa can be lysine or homocitrulline
  misc_feature (18)..(18): Xaa can be lysine or homocitrulline
ENEFVLIXXDVDEAYMNXI

SEQ ID NO: 618 - protein, 17 aa, rattus rattus
  misc_feature (2)..(2): Xaa can be lysine or homocitrulline
  misc_feature (11)..(11): Xaa can be lysine or homocitrulline
GXHGDDLRRSXTEISEM

SEQ ID NO: 619 - protein, 17 aa, equus caballus
  misc_feature (2)..(2): Xaa can be lysine or homocitrulline
  misc_feature (11)..(11): Xaa can be lysine or homocitrulline
GXHGDDLRRTXTEISET

SEQ ID NO: 620 - protein, 17 aa, gallus gallus
  misc_feature (2)..(2): Xaa can be lysine or homocitrulline
GXHGDDLRTTRSEISEL

SEQ ID NO: 621 - protein, 19 aa, murine
  misc_feature (6)..(6): Xaa can be lysine or homocitrulline
EIEALXGQRASLEAAIADA

SEQ ID NO: 622 - protein, 19 aa, rattus rattus
  misc_feature (6)..(6): Xaa can be lysine or homocitrulline
EIDALXGQRATLEAAIADA

SEQ ID NO: 623 - protein, 19 aa, equus caballus
  misc_feature (6)..(6): Xaa can be lysine or homocitrulline
EIDGLXGQNAALEAAIADA

SEQ ID NO: 624 - protein, 19 aa, gallus gallus
  misc_feature (6)..(6): Xaa can be lysine or homocitrulline
EIEVLXNQRATLETAIAEA

SEQ ID NO: 625 - protein, 19 aa, felis catus
  misc_feature (6)..(6): Xaa can be lysine or homocitrulline
EIEGLXNQRASLEAAVADA

SEQ ID NO: 626 - protein, 19 aa, canis lupus
  misc_feature (6)..(6): Xaa can be lysine or homocitrulline
EIETLXNQRAALEAAIADA

SEQ ID NO: 627 - protein, 19 aa, oryctolagus cuniculus
  misc_feature (6)..(6): Xaa can be lysine or homocitrulline
EIEALXGQRATLEAAIADA

SEQ ID NO: 628 - protein, 20 aa, murine
  misc_feature (9)..(9): Xaa can be lysine or homocitrulline
  misc_feature (14)..(14): Xaa can be lysine or homocitrulline
EQRGEMAIXDAQTXLAELEA

SEQ ID NO: 629 - protein, 20 aa, rattus rattus
  misc_feature (9)..(9): Xaa can be lysine or homocitrulline
  misc_feature (14)..(14): Xaa can be lysine or homocitrulline
  misc_feature (19)..(19): Xaa can be lysine or homocitrulline
EQRGELAVXDANAXLEDLXN

SEQ ID NO: 630 - protein, 20 aa, bos taurus
  misc_feature (9)..(9): Xaa can be lysine or homocitrulline
  misc_feature (14)..(14): Xaa can be lysine or homocitrulline
EQRGEMAVXDAQAXLAELEA

SEQ ID NO: 631 - protein, 20 aa, sus scrofa
  misc_feature (9)..(9): Xaa can be lysine or homocitrulline
  misc_feature (14)..(14): Xaa can be lysine or homocitrulline
EQRGELAVXDAQAXLAELEA

SEQ ID NO: 632 - protein, 20 aa, equus caballus
  misc_feature (9)..(9): Xaa can be lysine or homocitrulline
  misc_feature (14)..(14): Xaa can be lysine or homocitrulline
EQRGELAIXDAQDXVTELEV

SEQ ID NO: 633 - protein, 20 aa, gallus gallus
  misc_feature (9)..(9): Xaa can be lysine or homocitrulline
  misc_feature (14)..(14): Xaa can be lysine or homocitrulline
EERGEMALXDARAXLSELEA

SEQ ID NO: 634 - protein, 20 aa, felis catus
  misc_feature (9)..(9): Xaa can be lysine or homocitrulline
  misc_feature (14)..(14): Xaa can be lysine or homocitrulline
EQRGELAVXDANAXVAELEA

SEQ ID NO: 635 - protein, 20 aa, oryctolagus cuniculus
  misc_feature (9)..(9): Xaa can be lysine or homocitrulline
  misc_feature (14)..(14): Xaa can be lysine or homocitrulline
EQRGELAIXDANAXLAELEA

SEQ ID NO: 636 - protein, 20 aa, artificial
  Concensus sequence
  misc_feature (9)..(9): Xaa can be lysine or homocitrulline
  misc_feature (14)..(14): Xaa can be lysine or homocitrulline
EQRGELAVXDANAXLAELEA

SEQ ID NO: 637 - protein, 20 aa, bos taurus
  misc_feature (13)..(13): Xaa can be lysine or homocitrulline
RQLREYQELMNVXLALDVEI

SEQ ID NO: 638 - protein, 17 aa, bos taurus
  misc_feature (10)..(10): Xaa can be lysine or homocitrulline
REYQELMNVXLALDVEI

SEQ ID NO: 639 - protein, 19 aa, murine
  misc_feature (1)..(1): Xaa can be lysine or homocitrulline
  misc_feature (13)..(13): Xaa can be lysine or homocitrulline
XLALDIEITTYRXLLEGEE

SEQ ID NO: 640 - protein, 19 aa, bos taurus
  misc_feature (1)..(1): Xaa can be lysine or homocitrulline
  misc_feature (13)..(13): Xaa can be lysine or homocitrulline
XLALDVEIATYRXLLEGEE

SEQ ID NO: 641 - protein, 17 aa, bos taurus
  misc_feature (14)..(14): Xaa can be lysine or homocitrulline
PLRPQNYLFGCELXADR

SEQ ID NO: 642 - protein, 17 aa, gallus gallus
  misc_feature (14)..(14): Xaa can be lysine or homocitrulline
  misc_feature (17)..(17): Xaa can be lysine or homocitrulline
PLRPQTFLFGCELXAEX

SEQ ID NO: 643 - protein, 22 aa, gallus gallus
  misc_feature (6)..(6): Xaa can be lysine or homocitrulline
  misc_feature (13)..(13): Xaa can be lysine or homocitrulline
EGNPTXVVLASLXMSVQPTVSL

SEQ ID NO: 644 - protein, 21 aa, murine
  misc_feature (6)..(6): Xaa can be lysine or homocitrulline
  misc_feature (13)..(13): Xaa can be lysine or homocitrulline
DEEDVXLLGMSGXRSAPGGGN

SEQ ID NO: 645 - protein, 21 aa, bos taurus
  misc_feature (6)..(6): Xaa can be lysine or homocitrulline
  misc_feature (13)..(13): Xaa can be lysine or homocitrulline
EEEEVXLLSISGXRSAPGSGS

SEQ ID NO: 646 - protein, 21 aa, equus caballus
  misc_feature (6)..(6): Xaa can be lysine or homocitrulline
  misc_feature (13)..(13): Xaa can be lysine or homocitrulline
EEEDVXLLSISGXRSAPGSGS

SEQ ID NO: 647 - protein, 21 aa, gallus gallus
  misc_feature (6)..(6): Xaa can be lysine or homocitrulline
  misc_feature (13)..(13): Xaa can be lysine or homocitrulline
EEEDTXIGNASTXRPASGGGA

SEQ ID NO: 648 - protein, 19 aa, Homo sapiens
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
SXGQESFXXQEXTPXTPRG

SEQ ID NO: 649 - protein, 21 aa, gallus gallus
  misc_feature (2)..(2): Xaa can be lysine or homocitrulline
  misc_feature (4)..(4): Xaa can be lysine or homocitrulline
  misc_feature (9)..(10): Xaa can be lysine or homocitrulline
  misc_feature (12)..(12): Xaa can be lysine or homocitrulline
  misc_feature (17)..(17): Xaa can be lysine or homocitrulline
  misc_feature (20)..(20): Xaa can be lysine or homocitrulline
SXTXTPDSXXDXSLTPXTPXV

SEQ ID NO: 650 - protein, 19 aa, canis lupus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
TXGQESFXXQEXTPXTPXG

SEQ ID NO: 651 - protein, 20 aa, gallus gallus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GCSLPXLEPXFANYVXNCFR

SEQ ID NO: 652 - protein, 22 aa, gallus gallus
  misc_feature (2)..(2): Xaa can be lysine or homocitrulline
  misc_feature (8)..(8): Xaa can be lysine or homocitrulline
  misc_feature (17)..(17): Xaa can be lysine or homocitrulline
PXFANYVXNCFRTEDQXVIQAL

SEQ ID NO: 653 - protein, 20 aa, sus scrofa
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLACSIAXEGFEXISXGAN

SEQ ID NO: 654 - protein, 20 aa, gallus gallus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARAIAXEGFEXISXGAN

SEQ ID NO: 655 - protein, 19 aa, Homo sapiens
  misc_feature (11)..(11): Xaa can be lysine or homocitrulline
NDELEIIEGMXFDRGYISP

SEQ ID NO: 656 - protein, 19 aa, bos taurus
  misc_feature (11)..(11): Xaa can be lysine or homocitrulline
NDELEIIEGMXLYRGYISP

SEQ ID NO: 657 - protein, 20 aa, Homo sapiens
  misc_feature (14)..(14): Xaa can be lysine or homocitrulline
  misc_feature (16)..(16): Xaa can be lysine or homocitrulline
IIEQLDVTTSEYEXEXLNER

SEQ ID NO: 658 - protein, 20 aa, murine
  misc_feature (14)..(14): Xaa can be lysine or homocitrulline
  misc_feature (16)..(16): Xaa can be lysine or homocitrulline
ITEQLDITTSEYEXEXLNER

SEQ ID NO: 659 - protein, 20 aa, bos taurus
  misc_feature (14)..(14): Xaa can be lysine or homocitrulline
  misc_feature (16)..(16): Xaa can be lysine or homocitrulline
IIEQLDITTSEYEXEXLNER

SEQ ID NO: 660 - protein, 20 aa, gallus gallus
  misc_feature (14)..(14): Xaa can be lysine or homocitrulline
  misc_feature (16)..(16): Xaa can be lysine or homocitrulline
IIEQLEVTTSEYEXEXLNER

SEQ ID NO: 661 - protein, 20 aa, Homo sapiens
  misc_feature (7)..(7): Xaa can be lysine or homocitrulline
GIIDPTXVVRTALLDAAGVA

SEQ ID NO: 662 - protein, 20 aa, gallus gallus
  misc_feature (7)..(7): Xaa can be lysine or homocitrulline
GIIDPTXVVRTALMDAAGVA

SEQ ID NO: 663 - protein, 13 aa, Homo sapiens
  misc_feature (11)..(11): Xaa can be lysine or homocitrulline
ILRDYNFGNEXLT

SEQ ID NO: 664 - protein, 15 aa, Homo sapiens
IVRAITSGGGADGLT

SEQ ID NO: 665 - protein, 13 aa, Homo sapiens
  misc_feature (11)..(11): Xaa can be lysine or homocitrulline
IVLGLNTNAGXST

SEQ ID NO: 666 - protein, 10 aa, Homo sapiens
  misc_feature (8)..(8): Xaa can be lysine or homocitrulline
AVTANDYXLS

SEQ ID NO: 667 - protein, 11 aa, Homo sapiens
  misc_feature (9)..(9): Xaa can be lysine or homocitrulline
ALLNTGGFXTI

SEQ ID NO: 668 - protein, 12 aa, Homo sapiens
  misc_feature (10)..(10): Xaa can be lysine or homocitrulline
AVHQMNRDDXII

SEQ ID NO: 669 - protein, 11 aa, Homo sapiens
AVGQGGSYIPT

SEQ ID NO: 670 - protein, 8 aa, Homo sapiens
AVEWDDMR

SEQ ID NO: 671 - protein, 14 aa, Homo sapiens
AWSAWDPYSNQPQH

SEQ ID NO: 672 - protein, 16 aa, Homo sapiens
ASSNPGLAGNSYNEQF

SEQ ID NO: 673 - protein, 10 aa, Homo sapiens
AGNRGQTEAF

SEQ ID NO: 674 - protein, 11 aa, Homo sapiens
AWSFGGRNTIY

SEQ ID NO: 675 - protein, 14 aa, Homo sapiens
ASSPTGTGGSDIQY

SEQ ID NO: 676 - protein, 14 aa, Homo sapiens
ATSRDYPSSYNEQF

SEQ ID NO: 677 - protein, 11 aa, Homo sapiens
ASSVTLATEQY

SEQ ID NO: 678 - protein, 11 aa, Homo sapiens
AWSVRGTDTQY

SEQ ID NO: 679 - protein, 9 aa, Homo sapiens
AWSVQGEAF

SEQ ID NO: 680 - protein, 15 aa, Homo sapiens
ATSSDLGGAFNTEAF

SEQ ID NO: 681 - protein, 14 aa, Homo sapiens
ASSLDGAITASGYT

SEQ ID NO: 682 - DNA, 392 bp, Homo sapiens
gatgctggaatcacccagagcccaagacacaaggtcacagagacaggaacaccagtgactctgagatgtcatcagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagcgccgggaccaagagacccagtacttcgggccaggcacgcggctcctggtgctcgaggacctgaaaaacgtgttcccacccgaggtcgctgtgtttgagccatcaga

SEQ ID NO: 683 - protein, 130 aa, Homo sapiens
  misc_feature (11)..(11): Xaa can be lysine or homocitrulline
  misc_feature (53)..(53): Xaa can be lysine or homocitrulline
  misc_feature (57)..(57): Xaa can be lysine or homocitrulline
  misc_feature (70)..(70): Xaa can be lysine or homocitrulline
  misc_feature (117)..(117): Xaa can be lysine or homocitrulline
DAGITQSPRHXVTETGTPVTLRCHQTENHRYMYWYRQDPGHGLRLIHYSYGVXDTDXGEVSDGYSVSRSXTEDFLLTLESATSSQTSVYFCAISERRDQETQYFGPGTRLLVLEDLXNVFPPEVAVFEPS

SEQ ID NO: 684 - DNA, 373 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacgtttacgactacaagctcagctttggagccggaaccacagtaactgtaagagcaaatatccagaaccctgaccctgccgtgtaccagctgagagact

SEQ ID NO: 685 - protein, 124 aa, Homo sapiens
  misc_feature (3)..(3): Xaa can be lysine or homocitrulline
  misc_feature (69)..(69): Xaa can be lysine or homocitrulline
  misc_feature (97)..(97): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILRDVYDYXLSFGAGTTVTVRANIQNPDPAVYQLRD

SEQ ID NO: 686 - DNA, 395 bp, Homo sapiens
ggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgccccaatacatacagatacgcagtattttggcccaggcacccggctgacagtgctcgaggacctgaaaaacgtgttcccacccgaggtcgctgtgtttgagccatcaga

SEQ ID NO: 687 - protein, 131 aa, Homo sapiens
  misc_feature (14)..(14): Xaa can be lysine or homocitrulline
  misc_feature (20)..(20): Xaa can be lysine or homocitrulline
  misc_feature (41)..(41): Xaa can be lysine or homocitrulline
  misc_feature (55)..(55): Xaa can be lysine or homocitrulline
  misc_feature (64)..(64): Xaa can be lysine or homocitrulline
  misc_feature (66)..(66): Xaa can be lysine or homocitrulline
  misc_feature (118)..(118): Xaa can be lysine or homocitrulline
GAVVSQHPSWVICXSGTSVXIECRSLDFQATTMFWYRQFPXQSLMLMATSNEGSXATYEQGVEXDXFLINHASLTLSTLTVTSAHPEDSSFYICSAPIHTDTQYFGPGTRLTVLEDLXNVFPPEVAVFEPS

SEQ ID NO: 688 - DNA, 373 bp, Homo sapiens
gaagacaaggtggtacaaagccctctatctctggttgtccacgagggagacactgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaacttttcagcatcctgaacatcacagccacccagaccggagactcggccgtctacctctgtgctgtgcacgatgcaggcaacatgctcacctttggagggggaacaaggttaatggtcaaaccccatatccagaaccctgaccctgccgtgtaccagctgagagact

SEQ ID NO: 689 - protein, 124 aa, Homo sapiens
  misc_feature (3)..(3): Xaa can be lysine or homocitrulline
  misc_feature (37)..(37): Xaa can be lysine or homocitrulline
  misc_feature (40)..(41): Xaa can be lysine or homocitrulline
  misc_feature (56)..(57): Xaa can be lysine or homocitrulline
  misc_feature (67)..(68): Xaa can be lysine or homocitrulline
  misc_feature (109)..(109): Xaa can be lysine or homocitrulline
EDXVVQSPLSLVVHEGDTVTLNCSYEVTNFRSLLWYXQEXXAPTFLFMLTSSGIEXXSGRLSSILDXXELFSILNITATQTGDSAVYLCAVHDAGNMLTFGGGTRLMVXPHIQNPDPAVYQLRD

SEQ ID NO: 690 - DNA, 395 bp, Homo sapiens
gatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagggggggactagcctccaatgagcagttcttcgggccagggacacggctcaccgtgctagaggacctgaaaaacgtgttcccacccgaggtcgctgtgtttgagccatcaga

SEQ ID NO: 691 - protein, 131 aa, Homo sapiens
  misc_feature (24)..(24): Xaa can be lysine or homocitrulline
  misc_feature (68)..(68): Xaa can be lysine or homocitrulline
  misc_feature (78)..(78): Xaa can be lysine or homocitrulline
  misc_feature (118)..(118): Xaa can be lysine or homocitrulline
DAGVIQSPRHEVTEMGQEVTLRCXPISGHDYLFWYRQTMMRGLELLIYFNNNVPIDDSGMPEDRFSAXMPNASFSTLXIQPSEPRDSAVYFCASRGGLASNEQFFGPGTRLTVLEDLXNVFPPEVAVFEPS

SEQ ID NO: 692 - DNA, 385 bp, Homo sapiens
gcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagtgaaggcggaggaagctacatacctacatttggaagaggaaccagccttattgttcatccgtatatccagaaccctgaccctgccgtgtaccagctgagagact

SEQ ID NO: 693 - protein, 128 aa, Homo sapiens
  misc_feature (49)..(49): Xaa can be lysine or homocitrulline
  misc_feature (58)..(58): Xaa can be lysine or homocitrulline
  misc_feature (69)..(69): Xaa can be lysine or homocitrulline
  misc_feature (78)..(78): Xaa can be lysine or homocitrulline
AQSVTQLDSQVPVFEEAPVELRCNYSSSVSVYLFWYVQYPNQGLQLLLXYLSGSTLVXGINGFEAEFNXSQTSFHLRXPSVHISDTAEYFCAVSEGGGSYIPTFGRGTSLIVHPYIQNPDPAVYQLRD

SEQ ID NO: 694 - DNA, 389 bp, Homo sapiens
gatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtctcgggacattctacgagcagtacttcgggccgggcaccaggctcacggtcacagaggacctgaaaaacgtgttcccacccgaggtcgctgtgtttgagccatcaga

SEQ ID NO: 695 - protein, 129 aa, Homo sapiens
  misc_feature (9)..(9): Xaa can be lysine or homocitrulline
  misc_feature (14)..(14): Xaa can be lysine or homocitrulline
  misc_feature (57)..(57): Xaa can be lysine or homocitrulline
  misc_feature (70)..(71): Xaa can be lysine or homocitrulline
  misc_feature (83)..(83): Xaa can be lysine or homocitrulline
  misc_feature (116)..(116): Xaa can be lysine or homocitrulline
DGGITQSPXYLFRXEGQNVTLSCEQNLNHDAMYWYRQDPGQGLRLIYYSQIVNDFQXGDIAEGYSVSREXXESFPLTVTSAQXNPTAFYLCASSLGTFYEQYFGPGTRLTVTEDLXNVFPPEVAVFEPS

SEQ ID NO: 696 - DNA, 382 bp, Homo sapiens
ggagagaatgtggagcagcatccttcaaccctgagtgtccaggagggagacagcgctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtggtaacaccaatgcaggcaaatcaacctttggggatgggactacgctcactgtgaagccaaatatccagaaccctgaccctgccgtgtaccagctgagagact

SEQ ID NO: 697 - protein, 127 aa, Homo sapiens
  misc_feature (22)..(22): Xaa can be lysine or homocitrulline
  misc_feature (37)..(37): Xaa can be lysine or homocitrulline
  misc_feature (42)..(42): Xaa can be lysine or homocitrulline
  misc_feature (57)..(58): Xaa can be lysine or homocitrulline
  misc_feature (68)..(68): Xaa can be lysine or homocitrulline
  misc_feature (71)..(71): Xaa can be lysine or homocitrulline
  misc_feature (100)..(100): Xaa can be lysine or homocitrulline
  misc_feature (112)..(112): Xaa can be lysine or homocitrulline
GENVEQHPSTLSVQEGDSAVIXCTYSDSASNYFPWYXQELGXGPQLIIDIRSNVGEXXDQRIAVTLNXTAXHFSLHITETQPEDSAVYFCAASGNTNAGXSTFGDGTTLTVXPNIQNPDPAVYQLRD

SEQ ID NO: 698 - DNA, 401 bp, Homo sapiens
aaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttaggtgttatggtcgttagtacagatacgcagtattttggcccaggcacccggctgacagtgctcgaggacctgaaaaacgtgttcccacccgaggtcgctgtgtttgagccatcaga

SEQ ID NO: 699 - protein, 133 aa, Homo sapiens
  misc_feature (1)..(1): Xaa can be lysine or homocitrulline
  misc_feature (13)..(13): Xaa can be lysine or homocitrulline
  misc_feature (57)..(57): Xaa can be lysine or homocitrulline
  misc_feature (120)..(120): Xaa can be lysine or homocitrulline
XAGVTQTPRYLIXTRGQQVTLSCSPISGHRSVSWYQQTPGQGLQFLFEYFSETQRNXGNFPGRFSGRQFSNSRSEMNVSTLELGDSALYLCASSLGVMVVSTDTQYFGPGTRLTVLEDLXNVFPPEVAVFEPS

SEQ ID NO: 700 - DNA, 385 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacagggtctctaactttggaaatgagaaattaacctttgggactggaacaagactcaccatcatacccaatatccagaaccctgaccctgccgtgtaccagctgagagact

SEQ ID NO: 701 - protein, 128 aa, Homo sapiens
  misc_feature (3)..(3): Xaa can be lysine or homocitrulline
  misc_feature (69)..(69): Xaa can be lysine or homocitrulline
  misc_feature (101)..(101): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILRDRVSNFGNEXLTFGTGTRLTIIPNIQNPDPAVYQLRD

SEQ ID NO: 702 - DNA, 398 bp, Homo sapiens
gaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcccgacgcagggggcgtcctacgagcagtacttcgggccgggcaccaggctcacggtcacagaggacctgaaaaacgtgttcccacccgaggtcgctgtgtttgagccatcaga

SEQ ID NO: 703 - protein, 132 aa, Homo sapiens
  misc_feature (11)..(11): Xaa can be lysine or homocitrulline
  misc_feature (15)..(15): Xaa can be lysine or homocitrulline
  misc_feature (44)..(44): Xaa can be lysine or homocitrulline
  misc_feature (62)..(62): Xaa can be lysine or homocitrulline
  misc_feature (71)..(71): Xaa can be lysine or homocitrulline
  misc_feature (78)..(78): Xaa can be lysine or homocitrulline
  misc_feature (83)..(83): Xaa can be lysine or homocitrulline
  misc_feature (119)..(119): Xaa can be lysine or homocitrulline
EAGVAQSPRYXIIEXRQSVAFWCNPISGHATLYWYQQILGQGPXLLIQFQNNGVVDDSQLPXDRFSAERLXGVDSTLXIQPAXLEDSAVYLCASSPTQGASYEQYFGPGTRLTVTEDLXNVFPPEVAVFEPS

SEQ ID NO: 704 - DNA, 382 bp, Homo sapiens
gctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagacgcaggatacagcaccctcacctttgggaaggggactatgcttctagtctctccagatatccagaaccctgaccctgccgtgtaccagctgagagact

SEQ ID NO: 705 - protein, 127 aa, Homo sapiens
  misc_feature (22)..(22): Xaa can be lysine or homocitrulline
  misc_feature (49)..(49): Xaa can be lysine or homocitrulline
  misc_feature (58)..(58): Xaa can be lysine or homocitrulline
  misc_feature (69)..(69): Xaa can be lysine or homocitrulline
  misc_feature (77)..(78): Xaa can be lysine or homocitrulline
  misc_feature (105)..(105): Xaa can be lysine or homocitrulline
AQSVAQPEDQVNVAEGNPLTVXCTYSVSGNPYLFWYVQYPNRGLQFLLXYITGDNLVXGSYGFEAEFNXSQTSFHLXXPSALVSDSALYFCAVRDAGYSTLTFGXGTMLLVSPDIQNPDPAVYQLRD

SEQ ID NO: 706 - DNA, 379 bp, Homo sapiens
ggagagaatgtggagcagcatccttcaaccctgagtgtccaggagggagacagcgctgttatcaagtgcacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtatcgacagagatgacaagatcatctttggaaaagggacacgacttcatattctccccaatatccagaaccctgaccctgccgtgtaccagctgagagact

SEQ ID NO: 707 - protein, 126 aa, Homo sapiens
  misc_feature (22)..(22): Xaa can be lysine or homocitrulline
  misc_feature (37)..(37): Xaa can be lysine or homocitrulline
  misc_feature (42)..(42): Xaa can be lysine or homocitrulline
  misc_feature (57)..(58): Xaa can be lysine or homocitrulline
  misc_feature (68)..(68): Xaa can be lysine or homocitrulline
  misc_feature (71)..(71): Xaa can be lysine or homocitrulline
  misc_feature (99)..(99): Xaa can be lysine or homocitrulline
  misc_feature (104)..(104): Xaa can be lysine or homocitrulline
GENVEQHPSTLSVQEGDSAVIXCTYSDSASNYFPWYXQELGXGPQLIIDIRSNVGEXXDQRIAVTLNXTAXHFSLHITETQPEDSAVYFCAASIDRDDXIIFGXGTRLHILPNIQNPDPAVYQLRD

SEQ ID NO: 708 - DNA, 389 bp, Homo sapiens
gatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccactactcaggggtcctacaatgagcagttcttcgggccagggacacggctcaccgtgctagaggacctgaaaaacgtgttcccacccgaggtcgctgtgtttgagccatcaga

SEQ ID NO: 709 - protein, 129 aa, Homo sapiens
  misc_feature (3)..(3): Xaa can be lysine or homocitrulline
  misc_feature (13)..(13): Xaa can be lysine or homocitrulline
  misc_feature (18)..(18): Xaa can be lysine or homocitrulline
  misc_feature (53)..(53): Xaa can be lysine or homocitrulline
  misc_feature (55)..(55): Xaa can be lysine or homocitrulline
  misc_feature (57)..(57): Xaa can be lysine or homocitrulline
  misc_feature (70)..(71): Xaa can be lysine or homocitrulline
  misc_feature (116)..(116): Xaa can be lysine or homocitrulline
DVXVTQSSRYLVXRTGEXVFLECVQDMDHENMFWYRQDPGLGLRLIYFSYDVXMXEXGDIPEGYSVSREXXERFSLILESASTNQTSMYLCATTQGSYNEQFFGPGTRLTVLEDLXNVFPPEVAVFEPS

SEQ ID NO: 710 - DNA, 370 bp, Homo sapiens
gaagaccaggtgacgcagagtcccgaggccctgagactccaggagggagagagtagcagtctcaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggctggaagctacatacctacatttggaagaggaaccagccttattgttcatccgtatatccagaaccctgaccctgccgtgtaccagctgagagact

SEQ ID NO: 711 - protein, 123 aa, Homo sapiens
  misc_feature (42)..(42): Xaa can be lysine or homocitrulline
  misc_feature (57)..(57): Xaa can be lysine or homocitrulline
  misc_feature (59)..(59): Xaa can be lysine or homocitrulline
  misc_feature (63)..(63): Xaa can be lysine or homocitrulline
  misc_feature (68)..(69): Xaa can be lysine or homocitrulline
  misc_feature (79)..(79): Xaa can be lysine or homocitrulline
EDQVTQSPEALRLQEGESSSLNCSYTVSGLRGLFWYRQDPGXGPEFLFTLYSAGEEXEXERLXATLTXXESFLHITAPXPEDSATYLCAVQAGSYIPTFGRGTSLIVHPYIQNPDPAVYQLRD

SEQ ID NO: 712 - protein, 11 aa, Homo sapiens
  misc_feature (9)..(9): Xaa can be lysine or homocitrulline
AYRSYNTDXLI

SEQ ID NO: 713 - protein, 9 aa, Homo sapiens
AVAQGTALI

SEQ ID NO: 714 - protein, 10 aa, Homo sapiens
  misc_feature (3)..(3): Xaa can be lysine or homocitrulline
  misc_feature (8)..(8): Xaa can be lysine or homocitrulline
AVXPRGNXLV

SEQ ID NO: 715 - protein, 12 aa, Homo sapiens
  misc_feature (10)..(10): Xaa can be lysine or homocitrulline
AVMDNFGNEXLT

SEQ ID NO: 716 - protein, 10 aa, Homo sapiens
  misc_feature (8)..(8): Xaa can be lysine or homocitrulline
AYYNQGGXLI

SEQ ID NO: 717 - protein, 11 aa, Homo sapiens
  misc_feature (9)..(9): Xaa can be lysine or homocitrulline
VVTLTGGFXTI

SEQ ID NO: 718 - protein, 11 aa, Homo sapiens
AWGRDEPLRYT

SEQ ID NO: 719 - protein, 11 aa, Homo sapiens
AWSPTDAYEQY

SEQ ID NO: 720 - protein, 11 aa, Homo sapiens
ATQGAPNQPQH

SEQ ID NO: 721 - protein, 13 aa, Homo sapiens
AWTRGLAGVGELF

SEQ ID NO: 722 - protein, 13 aa, Homo sapiens
SVARDRTGVDTQY

SEQ ID NO: 723 - protein, 12 aa, Homo sapiens
ASTHGQIQETQY

SEQ ID NO: 724 - protein, 13 aa, Homo sapiens
ASSGQGAGANVLT

SEQ ID NO: 725 - protein, 13 aa, Homo sapiens
AWSVSGIPGNTIY

SEQ ID NO: 726 - protein, 10 aa, Homo sapiens
ASSLGQETQY

SEQ ID NO: 727 - DNA, 398 bp, Homo sapiens
ggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctcggactagcgggacgaatacgcagtattttggcccaggcacccggctgacagtgctcgaggacctgaaaaacgtgttcccacccgaggtcgctgtgtttgagccatcaga

SEQ ID NO: 728 - protein, 132 aa, Homo sapiens
  misc_feature (14)..(14): Xaa can be lysine or homocitrulline
  misc_feature (20)..(20): Xaa can be lysine or homocitrulline
  misc_feature (41)..(41): Xaa can be lysine or homocitrulline
  misc_feature (55)..(55): Xaa can be lysine or homocitrulline
  misc_feature (64)..(64): Xaa can be lysine or homocitrulline
  misc_feature (66)..(66): Xaa can be lysine or homocitrulline
  misc_feature (119)..(119): Xaa can be lysine or homocitrulline
GAVVSQHPSWVICXSGTSVXIECRSLDFQATTMFWYRQFPXQSLMLMATSNEGSXATYEQGVEXDXFLINHASLTLSTLTVTSAHPEDSSFYICSARTSGTNTQYFGPGTRLTVLEDLXNVFPPEVAVFEPS

SEQ ID NO: 729 - DNA, 382 bp, Homo sapiens
gcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagcggtcgtaacgactacaagctcagctttggagccggaaccacagtaactgtaagagcaaatatccagaaccctgaccctgccgtgtaccagctgagagact

SEQ ID NO: 730 - protein, 127 aa, Homo sapiens
  misc_feature (49)..(49): Xaa can be lysine or homocitrulline
  misc_feature (58)..(58): Xaa can be lysine or homocitrulline
  misc_feature (68)..(69): Xaa can be lysine or homocitrulline
  misc_feature (78)..(78): Xaa can be lysine or homocitrulline
  misc_feature (100)..(100): Xaa can be lysine or homocitrulline
AQSVTQLGSHVSVSEGALVLLRCNYSSSVPPYLFWYVQYPNQGLQLLLXYTSAATLVXGINGFEAEFXXSETSFHLTXPSAHMSDAAEYFCAVSGRNDYXLSFGAGTTVTVRANIQNPDPAVYQLRD

SEQ ID NO: 731 - DNA, 392 bp, Homo sapiens
aatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtcgctcctggacagcaagtggctacaccttcggttcggggaccaggttaaccgttgtagaggacctgaacaaggtgttcccacccgaggtcgctgtgtttgagccatcaga

SEQ ID NO: 732 - protein, 130 aa, Homo sapiens
  misc_feature (9)..(9): Xaa can be lysine or homocitrulline
  misc_feature (14)..(14): Xaa can be lysine or homocitrulline
  misc_feature (57)..(57): Xaa can be lysine or homocitrulline
  misc_feature (70)..(71): Xaa can be lysine or homocitrulline
  misc_feature (118)..(118): Xaa can be lysine or homocitrulline
NAGVTQTPXFRVLXTGQSMTLLCAQDMNHEYMYWYRQDPGMGLRLIHYSVGEGTTAXGEVPDGYNVSRLXXQNFLLGLESAAPSQTSVYFCASSRSWTASGYTFGSGTRLTVVEDLNXVFPPEVAVFEPS

SEQ ID NO: 733 - DNA, 376 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacgggtccggaaatgagaaattaacctttgggactggaacaagactcaccatcatacccaatatccagaaccctgaccctgccgtgtaccagctgagagact

SEQ ID NO: 734 - protein, 125 aa, Homo sapiens
  misc_feature (3)..(3): Xaa can be lysine or homocitrulline
  misc_feature (69)..(69): Xaa can be lysine or homocitrulline
  misc_feature (98)..(98): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILRDGSGNEXLTFGTGTRLTIIPNIQNPDPAVYQLRD

SEQ ID NO: 735 - DNA, 401 bp, Homo sapiens
gatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgtggcccaactagcgggaaagggtgagcagttcttcgggccagggacacggctcaccgtgctagaggacctgaaaaacgtgttcccacccgaggtcgctgtgtttgagccatcaga

SEQ ID NO: 736 - protein, 133 aa, Homo sapiens
  misc_feature (24)..(24): Xaa can be lysine or homocitrulline
  misc_feature (68)..(68): Xaa can be lysine or homocitrulline
  misc_feature (78)..(78): Xaa can be lysine or homocitrulline
  misc_feature (102)..(102): Xaa can be lysine or homocitrulline
  misc_feature (120)..(120): Xaa can be lysine or homocitrulline
DAGVIQSPRHEVTEMGQEVTLRCXPISGHNSLFWYRQTMMRGLELLIYFNNNVPIDDSGMPEDRFSAXMPNASFSTLXIQPSEPRDSAVYFCASSVAQLAGXGEQFFGPGTRLTVLEDLXNVFPPEVAVFEPS

SEQ ID NO: 737 - DNA, 392 bp, Homo sapiens
gaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagaagggtaatgggctatggctacaccttcggttcggggaccaggttaaccgttgtagaggacctgaacaaggtgttcccacccgaggtcgctgtgtttgagccatcaga

SEQ ID NO: 738 - protein, 130 aa, Homo sapiens
  misc_feature (42)..(42): Xaa can be lysine or homocitrulline
  misc_feature (57)..(57): Xaa can be lysine or homocitrulline
  misc_feature (78)..(78): Xaa can be lysine or homocitrulline
  misc_feature (83)..(83): Xaa can be lysine or homocitrulline
  misc_feature (118)..(118): Xaa can be lysine or homocitrulline
EPEVTQTPSHQVTQMGQEVILRCVPISNHLYFYWYRQILGQXVEFLVSFYNNEISEXSEIFDDQFSVERPDGSNFTLXIRSTXLEDSAMYFCASRRVMGYGYTFGSGTRLTVVEDLNXVFPPEVAVFEPS

SEQ ID NO: 739 - DNA, 382 bp, Homo sapiens
aaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctctgaatagtggaggtagcaactataaactgacatttggaaaaggaactctcttaaccgtgaatccaaatatccagaaccctgaccctgccgtgtaccagctgagagact

SEQ ID NO: 740 - protein, 127 aa, Homo sapiens
  misc_feature (1)..(1): Xaa can be lysine or homocitrulline
  misc_feature (42)..(42): Xaa can be lysine or homocitrulline
  misc_feature (68)..(68): Xaa can be lysine or homocitrulline
  misc_feature (100)..(100): Xaa can be lysine or homocitrulline
  misc_feature (105)..(105): Xaa can be lysine or homocitrulline
XQEVTQIPAALSVPEGENLVLNCSFTDSAIYNLQWFRQDPGXGLTSLLLIQSSQREQTSGRLNASLDXSSGRSTLYIAASQPGDSATYLCALNSGGSNYXLTFGXGTLLTVNPNIQNPDPAVYQLRD

SEQ ID NO: 741 - DNA, 407 bp, Homo sapiens
ggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgccggccgggcggggactagcggaacatacgagcagtacttcgggccgggcaccaggctcacggtcacagaggacctgaaaaacgtgttcccacccgaggtcgctgtgtttgagccatcaga

SEQ ID NO: 742 - protein, 135 aa, Homo sapiens
  misc_feature (14)..(14): Xaa can be lysine or homocitrulline
  misc_feature (20)..(20): Xaa can be lysine or homocitrulline
  misc_feature (41)..(41): Xaa can be lysine or homocitrulline
  misc_feature (55)..(55): Xaa can be lysine or homocitrulline
  misc_feature (64)..(64): Xaa can be lysine or homocitrulline
  misc_feature (66)..(66): Xaa can be lysine or homocitrulline
  misc_feature (122)..(122): Xaa can be lysine or homocitrulline
GAVVSQHPSWVICXSGTSVXIECRSLDFQATTMFWYRQFPXQSLMLMATSNEGSXATYEQGVEXDXFLINHASLTLSTLTVTSAHPEDSSFYICSAGRAGTSGTYEQYFGPGTRLTVTEDLXNVFPPEVAVFEPS

SEQ ID NO: 743 - DNA, 376 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagatctaactttggaaatgagaaattaacctttgggactggaacaagactcaccatcatacccaatatccagaaccctgaccctgccgtgtaccagctgagagact

SEQ ID NO: 744 - protein, 125 aa, Homo sapiens
  misc_feature (3)..(3): Xaa can be lysine or homocitrulline
  misc_feature (69)..(69): Xaa can be lysine or homocitrulline
  misc_feature (98)..(98): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILRSNFGNEXLTFGTGTRLTIIPNIQNPDPAVYQLRD

SEQ ID NO: 745 - DNA, 392 bp, Homo sapiens
gatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgggggacagttcaatcagccccagcattttggtgatgggactcgactctccatcctagaggacctgaacaaggtgttcccacccgaggtcgctgtgtttgagccatcaga

SEQ ID NO: 746 - protein, 130 aa, Homo sapiens
  misc_feature (9)..(9): Xaa can be lysine or homocitrulline
  misc_feature (14)..(14): Xaa can be lysine or homocitrulline
  misc_feature (57)..(57): Xaa can be lysine or homocitrulline
  misc_feature (70)..(71): Xaa can be lysine or homocitrulline
  misc_feature (83)..(83): Xaa can be lysine or homocitrulline
  misc_feature (118)..(118): Xaa can be lysine or homocitrulline
DGGITQSPXYLFRXEGQNVTLSCEQNLNHDAMYWYRQDPGQGLRLIYYSQIVNDFQXGDIAEGYSVSREXXESFPLTVTSAQXNPTAFYLCASSGGQFNQPQHFGDGTRLSILEDLNXVFPPEVAVFEPS

SEQ ID NO: 747 - DNA, 379 bp, Homo sapiens
agccaaaagatagaacagaattccgaggccctgaacattcaggagggtaaaacggccaccctgacctgcaactatacaaactattctccagcatacttacagtggtaccgacaagatccaggaagaggccctgttttcttgctacttatacgtgaaaatgagaaagaaaaaaggaaagaaagactgaaggtcacctttgataccacccttaaacagagtttgtttcatatcacagcctcccagcctgcagactcagctacctacctctgtgctctagggcaaactggggcaaacaacctcttctttgggactggaacgagactcaccgttattccctatatccagaaccctgaccctgccgtgtaccagctgagagact

SEQ ID NO: 748 - protein, 126 aa, Homo sapiens
  misc_feature (3)..(3): Xaa can be lysine or homocitrulline
  misc_feature (17)..(17): Xaa can be lysine or homocitrulline
  misc_feature (55)..(55): Xaa can be lysine or homocitrulline
  misc_feature (57)..(57): Xaa can be lysine or homocitrulline
  misc_feature (59)..(59): Xaa can be lysine or homocitrulline
  misc_feature (63)..(63): Xaa can be lysine or homocitrulline
  misc_feature (71)..(71): Xaa can be lysine or homocitrulline
SQXIEQNSEALNIQEGXTATLTCNYTNYSPAYLQWYRQDPGRGPVFLLLIRENEXEXRXERLXVTFDTTLXQSLFHITASQPADSATYLCALGQTGANNLFFGTGTRLTVIPYIQNPDPAVYQLRD

SEQ ID NO: 749 - DNA, 401 bp, Homo sapiens
aatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcacccgaggctctggcgaacaccggggagctgttttttggagaaggctctaggctgaccgtactggaggacctgaaaaacgtgttcccacccgaggtcgctgtgtttgagccatcaga

SEQ ID NO: 750 - protein, 133 aa, Homo sapiens
  misc_feature (27)..(27): Xaa can be lysine or homocitrulline
  misc_feature (44)..(44): Xaa can be lysine or homocitrulline
  misc_feature (51)..(51): Xaa can be lysine or homocitrulline
  misc_feature (62)..(62): Xaa can be lysine or homocitrulline
  misc_feature (71)..(71): Xaa can be lysine or homocitrulline
  misc_feature (120)..(120): Xaa can be lysine or homocitrulline
NAGVMQNPRHLVRRRGQEARLRCSPMXGHSHVYWYRQLPEEGLXFMVYLQXENIIDESGMPXERFSAEFPXEGPSILRIQQVVRGDSAAYFCASSPEALANTGELFFGEGSRLTVLEDLXNVFPPEVAVFEPS

SEQ ID NO: 751 - DNA, 376 bp, Homo sapiens
gatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtggggtacaataacaatgacatgcgctttggagcagggaccagactgacagtaaaaccaaatatccagaaccctgaccctgccgtgtaccagctgagagact

SEQ ID NO: 752 - protein, 125 aa, Homo sapiens
  misc_feature (3)..(3): Xaa can be lysine or homocitrulline
  misc_feature (52)..(52): Xaa can be lysine or homocitrulline
  misc_feature (69)..(69): Xaa can be lysine or homocitrulline
  misc_feature (110)..(110): Xaa can be lysine or homocitrulline
DAXTTQPPSMDCAEGRAANLPCNHSTISGNEYVYWYRQIHSQGPQYIIHGLXNNETNEMASLIITEDRXSSTLILPHATLRDTAVYYCIVRVGYNNNDMRFGAGTRLTVXPNIQNPDPAVYQLRD

SEQ ID NO: 753 - DNA, 395 bp, Homo sapiens
gatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgaccctagcgggcccccctacgagcagtacttcgggccgggcaccaggctcacggtcacagaggacctgaaaaacgtgttcccacccgaggtcgctgtgtttgagccatcaga

SEQ ID NO: 754 - protein, 131 aa, Homo sapiens
  misc_feature (14)..(14): Xaa can be lysine or homocitrulline
  misc_feature (17)..(17): Xaa can be lysine or homocitrulline
  misc_feature (27)..(27): Xaa can be lysine or homocitrulline
  misc_feature (53)..(53): Xaa can be lysine or homocitrulline
  misc_feature (57)..(57): Xaa can be lysine or homocitrulline
  misc_feature (73)..(73): Xaa can be lysine or homocitrulline
  misc_feature (118)..(118): Xaa can be lysine or homocitrulline
DADVTQTPRNRITXTGXRIMLECSQTXGHDRMYWYRQDPGLGLRLIYYSFDVXDINXGEISDGYSVSRQAQAXFSLSLESAIPNQTALYFCATSDPSGPPYEQYFGPGTRLTVTEDLXNVFPPEVAVFEPS

SEQ ID NO: 755 - DNA, 376 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagctcagggcggatctgaaaagctggtctttggaaagggaacgaaactgacagtaaacccatatatccagaaccctgaccctgccgtgtaccagctgagagact

SEQ ID NO: 756 - protein, 125 aa, Homo sapiens
  misc_feature (3)..(3): Xaa can be lysine or homocitrulline
  misc_feature (69)..(69): Xaa can be lysine or homocitrulline
  misc_feature (98)..(98): Xaa can be lysine or homocitrulline
  misc_feature (103)..(103): Xaa can be lysine or homocitrulline
  misc_feature (106)..(106): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILRAQGGSEXLVFGXGTXLTVNPYIQNPDPAVYQLRD

SEQ ID NO: 757 - DNA, 395 bp, Homo sapiens
gaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagagccgggacagggatagggggctacaccttcggttcggggaccaggttaaccgttgtagaggacctgaacaaggtgttcccacccgaggtcgctgtgtttgagccatcaga

SEQ ID NO: 758 - protein, 131 aa, Homo sapiens
  misc_feature (42)..(42): Xaa can be lysine or homocitrulline
  misc_feature (57)..(57): Xaa can be lysine or homocitrulline
  misc_feature (78)..(78): Xaa can be lysine or homocitrulline
  misc_feature (83)..(83): Xaa can be lysine or homocitrulline
  misc_feature (119)..(119): Xaa can be lysine or homocitrulline
EPEVTQTPSHQVTQMGQEVILRCVPISNHLYFYWYRQILGQXVEFLVSFYNNEISEXSEIFDDQFSVERPDGSNFTLXIRSTXLEDSAMYFCASRAGTGIGGYTFGSGTRLTVVEDLNXVFPPEVAVFEPS

SEQ ID NO: 759 - DNA, 382 bp, Homo sapiens
aaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtttatagtggaggtagcaactataaactgacatttggaaaaggaactctcttaaccgtgaatccaaatatccagaaccctgaccctgccgtgtaccagctgagagact

SEQ ID NO: 760 - protein, 127 aa, Homo sapiens
  misc_feature (1)..(1): Xaa can be lysine or homocitrulline
  misc_feature (42)..(42): Xaa can be lysine or homocitrulline
  misc_feature (68)..(68): Xaa can be lysine or homocitrulline
  misc_feature (100)..(100): Xaa can be lysine or homocitrulline
  misc_feature (105)..(105): Xaa can be lysine or homocitrulline
XQEVTQIPAALSVPEGENLVLNCSFTDSAIYNLQWFRQDPGXGLTSLLLIQSSQREQTSGRLNASLDXSSGRSTLYIAASQPGDSATYLCAVYSGGSNYXLTFGXGTLLTVNPNIQNPDPAVYQLRD

SEQ ID NO: 761 - protein, 12 aa, Homo sapiens
  misc_feature (10)..(10): Xaa can be lysine or homocitrulline
IVGLRWNTDXLI

SEQ ID NO: 762 - protein, 7 aa, Homo sapiens
  misc_feature (5)..(5): Xaa can be lysine or homocitrulline
AVHYXLS

SEQ ID NO: 763 - protein, 11 aa, Homo sapiens
ATPGPGANNLF

SEQ ID NO: 764 - protein, 12 aa, Homo sapiens
AVSEWGGSYIPT

SEQ ID NO: 765 - protein, 10 aa, Homo sapiens
ALSGGSYIPT

SEQ ID NO: 766 - protein, 11 aa, Homo sapiens
  misc_feature (9)..(9): Xaa can be lysine or homocitrulline
ALNSGGYQXVT

SEQ ID NO: 767 - protein, 13 aa, Homo sapiens
ALEGNGGSQGNLI

SEQ ID NO: 768 - protein, 10 aa, Homo sapiens
  misc_feature (8)..(8): Xaa can be lysine or homocitrulline
ILRDVYDXLS

SEQ ID NO: 769 - protein, 14 aa, Homo sapiens
  misc_feature (12)..(12): Xaa can be lysine or homocitrulline
IVRDGSNFGNEXLT

SEQ ID NO: 770 - protein, 18 aa, Homo sapiens
  misc_feature (16)..(16): Xaa can be lysine or homocitrulline
ILRDGLGPRADFGNEXLT

SEQ ID NO: 771 - protein, 10 aa, Homo sapiens
  misc_feature (8)..(8): Xaa can be lysine or homocitrulline
AVVQGTDXLI

SEQ ID NO: 772 - protein, 12 aa, Homo sapiens
AYRSVYNNNDMR

SEQ ID NO: 773 - protein, 10 aa, Homo sapiens
AWRSQPGELF

SEQ ID NO: 774 - protein, 16 aa, Homo sapiens
ASSLQGGLAGARVRQF

SEQ ID NO: 775 - protein, 14 aa, Homo sapiens
AISESGGRGADTQY

SEQ ID NO: 776 - protein, 12 aa, Homo sapiens
  misc_feature (8)..(8): Xaa can be lysine or homocitrulline
SVIQGTAXNIQY

SEQ ID NO: 777 - protein, 10 aa, Homo sapiens
SVGDGRDTQY

SEQ ID NO: 778 - protein, 11 aa, Homo sapiens
SGGGTGRTEAF

SEQ ID NO: 779 - protein, 11 aa, Homo sapiens
ACDQRRDNEQF

SEQ ID NO: 780 - protein, 15 aa, Homo sapiens
ATSRDPGGRALNEQF

SEQ ID NO: 781 - protein, 9 aa, Homo sapiens
  misc_feature (4)..(4): Xaa can be lysine or homocitrulline
SVGXGETQY

SEQ ID NO: 782 - protein, 9 aa, Homo sapiens
ASRQLIRRY

SEQ ID NO: 783 - protein, 15 aa, Homo sapiens
  misc_feature (11)..(11): Xaa can be lysine or homocitrulline
ASSGGIAAALXETQY

SEQ ID NO: 784 - protein, 11 aa, Homo sapiens
ASSSSSPGEQY

SEQ ID NO: 785 - protein, 14 aa, Homo sapiens
ASSQDPGQGPTEAF

SEQ ID NO: 786 - protein, 14 aa, Homo sapiens
  misc_feature (4)..(4): Xaa can be lysine or homocitrulline
ASTXAGPGGTSPLH

SEQ ID NO: 787 - DNA, 389 bp, Homo sapiens
gatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttattggggagctcacccctccactttgggaatgggaccaggctcactgtgacagaggacctgaacaaggtgttcccacccgaggtcgctgtgtttgagccatcaga

SEQ ID NO: 788 - protein, 129 aa, Homo sapiens
  misc_feature (3)..(3): Xaa can be lysine or homocitrulline
  misc_feature (13)..(13): Xaa can be lysine or homocitrulline
  misc_feature (18)..(18): Xaa can be lysine or homocitrulline
  misc_feature (53)..(53): Xaa can be lysine or homocitrulline
  misc_feature (55)..(55): Xaa can be lysine or homocitrulline
  misc_feature (57)..(57): Xaa can be lysine or homocitrulline
  misc_feature (70)..(71): Xaa can be lysine or homocitrulline
  misc_feature (117)..(117): Xaa can be lysine or homocitrulline
DVXVTQSSRYLVXRTGEXVFLECVQDMDHENMFWYRQDPGLGLRLIYFSYDVXMXEXGDIPEGYSVSREXXERFSLILESASTNQTSMYLCASSLLGSSPLHFGNGTRLTVTEDLNXVFPPEVAVFEPS

SEQ ID NO: 789 - DNA, 388 bp, Homo sapiens
gctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagttataaccagggaggaaagcttatcttcggacagggaacggagttatctgtgaaacccaatatccagaaccctgaccctgccgtgtaccagctgagagact

SEQ ID NO: 790 - protein, 129 aa, Homo sapiens
  misc_feature (38)..(38): Xaa can be lysine or homocitrulline
  misc_feature (55)..(55): Xaa can be lysine or homocitrulline
  misc_feature (70)..(70): Xaa can be lysine or homocitrulline
  misc_feature (73)..(73): Xaa can be lysine or homocitrulline
  misc_feature (78)..(78): Xaa can be lysine or homocitrulline
  misc_feature (102)..(102): Xaa can be lysine or homocitrulline
  misc_feature (114)..(114): Xaa can be lysine or homocitrulline
AQTVTQSQPEMSVQEAETVTLSCTYDTSESDYYLFWYXQPPSRQMILVIRQEAYXQQNATENRFSVNFQXAAXSFSLXISDSQLGDAAMYFCAYRSYNQGGXLIFGQGTELSVXPNIQNPDPAVYQLRD

SEQ ID NO: 791 - DNA, 395 bp, Homo sapiens
gacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaagagcctagtacccacaatgagcagttcttcgggccagggacacggctcaccgtgctagaggacctgaaaaacgtgttcccacccgaggtcgctgtgtttgagccatcaga

SEQ ID NO: 792 - protein, 131 aa, Homo sapiens
  misc_feature (9)..(9): Xaa can be lysine or homocitrulline
  misc_feature (19)..(19): Xaa can be lysine or homocitrulline
  misc_feature (22)..(22): Xaa can be lysine or homocitrulline
  misc_feature (36)..(36): Xaa can be lysine or homocitrulline
  misc_feature (40)..(41): Xaa can be lysine or homocitrulline
  misc_feature (44)..(44): Xaa can be lysine or homocitrulline
  misc_feature (52)..(52): Xaa can be lysine or homocitrulline
  misc_feature (67)..(67): Xaa can be lysine or homocitrulline
  misc_feature (71)..(71): Xaa can be lysine or homocitrulline
  misc_feature (118)..(118): Xaa can be lysine or homocitrulline
DTAVSQTPXYLVTQMGNDXSIXCEQNLGHDTMYWYXQDSXXFLXIMFSYNNXELIINETVPNRFSPXSPDXAHLNLHINSLELGDSAVYFCASSQEPSTHNEQFFGPGTRLTVLEDLXNVFPPEVAVFEPS

SEQ ID NO: 793 - DNA, 379 bp, Homo sapiens
gatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgaagaattatggaggaagccaaggaaatctcatctttggaaaaggcactaaactctctgttaaaccaaatatccagaaccctgaccctgccgtgtaccagctgagagact

SEQ ID NO: 794 - protein, 126 aa, Homo sapiens
  misc_feature (3)..(3): Xaa can be lysine or homocitrulline
  misc_feature (69)..(69): Xaa can be lysine or homocitrulline
  misc_feature (91)..(91): Xaa can be lysine or homocitrulline
  misc_feature (104)..(104): Xaa can be lysine or homocitrulline
  misc_feature (107)..(107): Xaa can be lysine or homocitrulline
  misc_feature (111)..(111): Xaa can be lysine or homocitrulline
DAXTTQPNSMESNEEEPVHLPCNHSTISGTDYIHWYRQLPSQGPEYVIHGLTSNVNNRMASLAIAEDRXSSTLILHRATLRDAAVYYCILXNYGGSQGNLIFGXGTXLSVXPNIQNPDPAVYQLRD

SEQ ID NO: 795 - DNA, 389 bp, Homo sapiens
aatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagcccgggacagccctatggctacaccttcggttcggggaccaggttaaccgttgtagaggacctgaacaaggtgttcccacccgaggtcgctgtgtttgagccatcaga

SEQ ID NO: 796 - protein, 129 aa, Homo sapiens
  misc_feature (9)..(9): Xaa can be lysine or homocitrulline
  misc_feature (14)..(14): Xaa can be lysine or homocitrulline
  misc_feature (44)..(44): Xaa can be lysine or homocitrulline
  misc_feature (57)..(57): Xaa can be lysine or homocitrulline
  misc_feature (117)..(117): Xaa can be lysine or homocitrulline
NAGVTQTPXFRILXIGQSMTLQCTQDMNHNYMYWYRQDPGMGLXLIYYSVGAGITDXGEVPNGYNVSRSTTEDFPLRLELAAPSQTSVYFCASSPGQPYGYTFGSGTRLTVVEDLNXVFPPEVAVFEPS

SEQ ID NO: 797 - DNA, 373 bp, Homo sapiens
gcccagagagtgactcagcccgagaagctcctctctgtctttaaaggggccccagtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtggcccgagctatggtcagaattttgtctttggtcccggaaccagattgtccgtgctgccctatatccagaaccctgaccctgccgtgtaccagctgagagact

SEQ ID NO: 798 - protein, 124 aa, Homo sapiens
  misc_feature (9)..(9): Xaa can be lysine or homocitrulline
  misc_feature (15)..(15): Xaa can be lysine or homocitrulline
  misc_feature (22)..(22): Xaa can be lysine or homocitrulline
  misc_feature (57)..(57): Xaa can be lysine or homocitrulline
  misc_feature (65)..(65): Xaa can be lysine or homocitrulline
  misc_feature (73)..(74): Xaa can be lysine or homocitrulline
AQRVTQPEXLLSVFXGAPVELXCNYSYSGSPELFWYVQYSRQRLQLLLRHISRESIXGFTADLNXGETSFHLXXPFAQEEDSAMYYCALSGPSYGQNFVFGPGTRLSVLPYIQNPDPAVYQLRD

SEQ ID NO: 799 - DNA, 392 bp, Homo sapiens
aatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcgagggactagcctcctacaatgagcagttcttcgggccagggacacggctcaccgtgctagaggacctgaaaaacgtgttcccacccgaggtcgctgtgtttgagccatcaga

SEQ ID NO: 800 - protein, 130 aa, Homo sapiens
  misc_feature (9)..(9): Xaa can be lysine or homocitrulline
  misc_feature (14)..(14): Xaa can be lysine or homocitrulline
  misc_feature (57)..(57): Xaa can be lysine or homocitrulline
  misc_feature (71)..(71): Xaa can be lysine or homocitrulline
  misc_feature (117)..(117): Xaa can be lysine or homocitrulline
NAGVTQTPXFQVLXTGQSMTLQCAQDMNHNSMYWYRQDPGMGLRLIYYSASEGTTDXGEVPNGYNVSRLNXREFSLRLESAAPSQTSVYFCASEGLASYNEQFFGPGTRLTVLEDLXNVFPPEVAVFEPS

SEQ ID NO: 801 - DNA, 379 bp, Homo sapiens
ggaaattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctaacgggggggggttaccagaaagttacctttggaactggaacaaagctccaagtcatcccaaatatccagaaccctgaccctgccgtgtaccagctgagagact

SEQ ID NO: 802 - protein, 126 aa, Homo sapiens
  misc_feature (49)..(49): Xaa can be lysine or homocitrulline
  misc_feature (52)..(52): Xaa can be lysine or homocitrulline
  misc_feature (56)..(56): Xaa can be lysine or homocitrulline
  misc_feature (60)..(60): Xaa can be lysine or homocitrulline
  misc_feature (68)..(68): Xaa can be lysine or homocitrulline
  misc_feature (77)..(77): Xaa can be lysine or homocitrulline
  misc_feature (99)..(99): Xaa can be lysine or homocitrulline
  misc_feature (107)..(107): Xaa can be lysine or homocitrulline
GNSVTQMEGPVTLSEEAFLTINCTYTATGYPSLFWYVQYPGEGLQLLLXATXADDXGSNXGFEATYRXETTSFHLEXGSVQVSDSAVYFCALTGGGYQXVTFGTGTXLQVIPNIQNPDPAVYQLRD

SEQ ID NO: 803 - DNA, 389 bp, Homo sapiens
gaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttcagggagggtgaaaaactgttttttggcagtggaacccagctctctgtcttggaggacctgaacaaggtgttcccacccgaggtcgctgtgtttgagccatcaga

SEQ ID NO: 804 - protein, 129 aa, Homo sapiens
  misc_feature (17)..(18): Xaa can be lysine or homocitrulline
  misc_feature (57)..(57): Xaa can be lysine or homocitrulline
  misc_feature (65)..(65): Xaa can be lysine or homocitrulline
  misc_feature (69)..(69): Xaa can be lysine or homocitrulline
  misc_feature (71)..(71): Xaa can be lysine or homocitrulline
  misc_feature (100)..(100): Xaa can be lysine or homocitrulline
  misc_feature (117)..(117): Xaa can be lysine or homocitrulline
EAQVTQNPRYLITVTGXXLTVTCSQNMNHEYMSWYRQDPGLGLRQIYYSMNVEVTDXGDVPEGYXVSRXEXRNFPLILESPSPNQTSLYFCASSFREGEXLFFGSGTQLSVLEDLNXVFPPEVAVFEPS

SEQ ID NO: 805 - DNA, 379 bp, Homo sapiens
agtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggcgatgaacacaggctttcagaaacttgtatttggaactggcacccgacttctggtcagtccaaatatccagaaccctgaccctgccgtgtaccagctgagagact

SEQ ID NO: 806 - protein, 126 aa, Homo sapiens
  misc_feature (26)..(26): Xaa can be lysine or homocitrulline
  misc_feature (56)..(56): Xaa can be lysine or homocitrulline
  misc_feature (69)..(70): Xaa can be lysine or homocitrulline
  misc_feature (99)..(99): Xaa can be lysine or homocitrulline
SQQGEEDPQALSIQEGENATMNCSYXTSINNLQWYRQNSGRGLVHLILIRSNEREXHSGRLRVTLDTSXXSSSLLITASRAADTASYFCATAMNTGFQXLVFGTGTRLLVSPNIQNPDPAVYQLRD

SEQ ID NO: 807 - DNA, 398 bp, Homo sapiens
gaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccgggagggactagcgggattaaatgagcagttcttcgggccagggacacggctcaccgtgctagaggacctgaaaaacgtgttcccacccgaggtcgctgtgtttgagccatcaga

SEQ ID NO: 808 - protein, 132 aa, Homo sapiens
  misc_feature (18)..(19): Xaa can be lysine or homocitrulline
  misc_feature (22)..(22): Xaa can be lysine or homocitrulline
  misc_feature (36)..(36): Xaa can be lysine or homocitrulline
  misc_feature (40)..(41): Xaa can be lysine or homocitrulline
  misc_feature (52)..(52): Xaa can be lysine or homocitrulline
  misc_feature (119)..(119): Xaa can be lysine or homocitrulline
ETGVTQTPRHLVMGMTNXXSLXCEQHLGHNAMYWYXQSAXXPLELMFVYNFXEQTENNSVPSRFSPECPNSSHLFLHLHTLQPEDSALYLCASSREGLAGLNEQFFGPGTRLTVLEDLXNVFPPEVAVFEPS

SEQ ID NO: 809 - DNA, 391 bp, Homo sapiens
gaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcggctggggtgatggtggtgctacaaacaagctcatctttggaactggcactctgcttgctgtccagccaaatatccagaaccctgaccctgccgtgtaccagctgagagact

SEQ ID NO: 810 - protein, 130 aa, Homo sapiens
  misc_feature (5)..(5): Xaa can be lysine or homocitrulline
  misc_feature (37)..(38): Xaa can be lysine or homocitrulline
  misc_feature (54)..(54): Xaa can be lysine or homocitrulline
  misc_feature (56)..(56): Xaa can be lysine or homocitrulline
  misc_feature (68)..(68): Xaa can be lysine or homocitrulline
  misc_feature (71)..(71): Xaa can be lysine or homocitrulline
  misc_feature (103)..(103): Xaa can be lysine or homocitrulline
DQQVXQNSPSLSVQEGRISILNCDYTNSMFDYFLWYXXYPAEGPTFLISISSIXDXNEDGRFTVFLNXSAXHLSLHIVPSQPGDSAVYFCAASGWGDGGATNXLIFGTGTLLAVQPNIQNPDPAVYQLRD

SEQ ID NO: 811 - protein, 9 aa, Homo sapiens
  misc_feature (8)..(8): Xaa can be lysine or homocitrulline
FHETLYQXA

SEQ ID NO: 812 - protein, 9 aa, Homo sapiens
  misc_feature (1)..(1): Xaa can be lysine or homocitrulline
XVLSVCSSN

SEQ ID NO: 813 - protein, 364 aa, Homo sapiens
  misc_feature (13)..(14): Xaa can be lysine or homocitrulline
  misc_feature (28)..(28): Xaa can be lysine or homocitrulline
  misc_feature (42)..(42): Xaa can be lysine or homocitrulline
  misc_feature (71)..(72): Xaa can be lysine or homocitrulline
  misc_feature (87)..(87): Xaa can be lysine or homocitrulline
  misc_feature (101)..(101): Xaa can be lysine or homocitrulline
  misc_feature (108)..(108): Xaa can be lysine or homocitrulline
  misc_feature (111)..(111): Xaa can be lysine or homocitrulline
  misc_feature (139)..(140): Xaa can be lysine or homocitrulline
  misc_feature (147)..(147): Xaa can be lysine or homocitrulline
  misc_feature (153)..(153): Xaa can be lysine or homocitrulline
  misc_feature (200)..(200): Xaa can be lysine or homocitrulline
  misc_feature (208)..(208): Xaa can be lysine or homocitrulline
  misc_feature (215)..(215): Xaa can be lysine or homocitrulline
  misc_feature (230)..(230): Xaa can be lysine or homocitrulline
  misc_feature (243)..(243): Xaa can be lysine or homocitrulline
  misc_feature (330)..(330): Xaa can be lysine or homocitrulline
  misc_feature (342)..(342): Xaa can be lysine or homocitrulline
MPHSYPALSAEQXXELSDIALRIVAPGXGILAADESVGSMAXRLSQIGVENTEENRRLYRQVLFSADDRVXXCIGGVIFFHETLYQXDDNGVPFVRTIQDXGIVVGIXVDXGVVPLAGTDGETTTQGLDGLSERCAQYXXDGADFAXWRCVLXISERTPSALAILENANVLARYASICQQNGIVPIVEPEILPDGDHDLXRCQYVTEXVLAAVYXALSDHHVYLEGTLLXPNMVTPGHACPIXYTPEEIAMATVTALRRTVPPAVPGVTFLSGGQSEEEASFNLNAINRCPLPRPWALTFSYGRALQASALNAWRGQRDNAGAATEEFIXRAEVNGLAAQGXYEGSGEDGGAAAQSLYIANHAY

SEQ ID NO: 814 - protein, 23 aa, Murine
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 815 - protein, 23 aa, Bos taurus
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 816 - protein, 23 aa, Sus scrofa
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 817 - protein, 23 aa, Equus caballus
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 818 - protein, 23 aa, Ovis aries
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 819 - protein, 23 aa, Canis lupus
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 820 - protein, 23 aa, Oryctolagus cuniculus
  misc_feature (19)..(19): Xaa can be lysine or homocitrulline
FSLADAINTEFRNTRTNEXVELQ

SEQ ID NO: 821 - protein, 23 aa, artificial
  Concensus sequence
  misc_feature (12)..(12): Xaa can be lysine or homocitrulline
  misc_feature (19)..(19): Xaa can be lysine or homocitrulline
FSLADAINTEFXNTRTNEXVELQ

SEQ ID NO: 822 - protein, 20 aa, Murine
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 823 - protein, 20 aa, Bos taurus
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 824 - protein, 20 aa, Sus scrofa
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 825 - protein, 20 aa, Equus caballus
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 826 - protein, 20 aa, Ovis aries
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 827 - protein, 20 aa, Canis lupus
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 828 - protein, 20 aa, artificial
  Concensus sequence
  misc_feature (2)..(2): Xaa can be lysine or homocitrulline
  misc_feature (9)..(9): Xaa can be lysine or homocitrulline
FXNTRTNEXVELQELNDRFA

SEQ ID NO: 829 - protein, 22 aa, Murine
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 830 - protein, 22 aa, Bos taurus
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 831 - protein, 22 aa, Sus scrofa
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 832 - protein, 22 aa, Equus caballus
  misc_feature (4)..(4): Xaa can be lysine or homocitrulline
  misc_feature (20)..(20): Xaa can be lysine or homocitrulline
TNEXVELQELNDRFASYIDXVR

SEQ ID NO: 833 - protein, 22 aa, Gallus gallus
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 834 - protein, 22 aa, Ovis aries
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 835 - protein, 22 aa, Canis lupus
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 836 - protein, 22 aa, Oryctolagus cuniculus
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 837 - protein, 22 aa, artificial
  Concensus sequence
  misc_feature (4)..(4): Xaa can be lysine or homocitrulline
  misc_feature (20)..(20): Xaa can be lysine or homocitrulline
TNEXVELQELNDRFANYIDXVR

SEQ ID NO: 838 - protein, 20 aa, Murine
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 839 - protein, 20 aa, Bos taurus
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 840 - protein, 20 aa, Sus scrofa
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 841 - protein, 20 aa, Gallus gallus
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 842 - protein, 20 aa, Ovis aries
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 843 - protein, 20 aa, Canis lupus
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 844 - protein, 20 aa, Oryctolagus cuniculus
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 845 - protein, 20 aa, artificial
  Concensus sequence
  misc_feature (5)..(5): Xaa can be lysine or homocitrulline
  misc_feature (14)..(14): Xaa can be lysine or homocitrulline
NYIDXVRFLEQQNXILLAEL

SEQ ID NO: 846 - protein, 15 aa, Murine
  misc_feature (1)..(1): Xaa can be lysine or homocitrulline
  misc_feature (10)..(10): Xaa can be lysine or homocitrulline
XVRFLEQQNXILLAE

SEQ ID NO: 847 - protein, 15 aa, Bos taurus
  misc_feature (1)..(1): Xaa can be lysine or homocitrulline
  misc_feature (10)..(10): Xaa can be lysine or homocitrulline
XVRFLEQQNXILLAE

SEQ ID NO: 848 - protein, 15 aa, Sus scrofa
  misc_feature (1)..(1): Xaa can be lysine or homocitrulline
  misc_feature (10)..(10): Xaa can be lysine or homocitrulline
XVRFLEQQNXILLAE

SEQ ID NO: 849 - protein, 15 aa, Equus caballus
  misc_feature (1)..(1): Xaa can be lysine or homocitrulline
  misc_feature (10)..(10): Xaa can be lysine or homocitrulline
XVRFLEQQNXILLAE

SEQ ID NO: 850 - protein, 15 aa, Gallus gallus
  misc_feature (1)..(1): Xaa can be lysine or homocitrulline
  misc_feature (10)..(10): Xaa can be lysine or homocitrulline
XVRFLEQQNXILLAE

SEQ ID NO: 851 - protein, 15 aa, Ovis aries
  misc_feature (1)..(1): Xaa can be lysine or homocitrulline
  misc_feature (10)..(10): Xaa can be lysine or homocitrulline
XVRFLEQQNXILLAE

SEQ ID NO: 852 - protein, 15 aa, Canis lupus
  misc_feature (1)..(1): Xaa can be lysine or homocitrulline
  misc_feature (10)..(10): Xaa can be lysine or homocitrulline
XVRFLEQQNXILLAE

SEQ ID NO: 853 - protein, 15 aa, Oryctolagus cuniculus
  misc_feature (1)..(1): Xaa can be lysine or homocitrulline
  misc_feature (10)..(10): Xaa can be lysine or homocitrulline
XVRFLEQQNXILLAE

SEQ ID NO: 854 - protein, 15 aa, artificial
  Concensus sequence
  misc_feature (1)..(1): Xaa can be lysine or homocitrulline
  misc_feature (10)..(10): Xaa can be lysine or homocitrulline
XVRFLEQQNXILLAE

SEQ ID NO: 855 - protein, 21 aa, Murine
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 856 - protein, 21 aa, Bos taurus
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 857 - protein, 21 aa, Sus scrofa
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 858 - protein, 21 aa, Equus caballus
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 859 - protein, 21 aa, Ovis aries
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 860 - protein, 21 aa, Canis lupus
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 861 - protein, 21 aa, Oryctolagus cuniculus
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 862 - protein, 21 aa, artificial
  Concensus sequence
  misc_feature (9)..(9): Xaa can be lysine or homocitrulline
  misc_feature (21)..(21): Xaa can be lysine or homocitrulline
LARLDLERXVESLQEEIAFLX

SEQ ID NO: 863 - protein, 21 aa, Murine
  misc_feature (8)..(8): Xaa can be lysine or homocitrulline
QIDVDVSXPDLTAALRDVRQQ

SEQ ID NO: 864 - protein, 21 aa, Bos taurus
  misc_feature (8)..(8): Xaa can be lysine or homocitrulline
QIDMDVSXPDLTAALRDVRQQ

SEQ ID NO: 865 - protein, 21 aa, Sus scrofa
  misc_feature (8)..(8): Xaa can be lysine or homocitrulline
QIDMDVSXPDLTAALRDVRQQ

SEQ ID NO: 866 - protein, 21 aa, Equus caballus
  misc_feature (8)..(8): Xaa can be lysine or homocitrulline
QIDVDVSXPDLTAALRDVRQQ

SEQ ID NO: 867 - protein, 21 aa, Gallus gallus
  misc_feature (8)..(8): Xaa can be lysine or homocitrulline
QIDMDVSXPDLTAALRDVRQQ

SEQ ID NO: 868 - protein, 21 aa, Canis lupus
  misc_feature (8)..(8): Xaa can be lysine or homocitrulline
QIDMDVSXPDLTAALRDVRQQ

SEQ ID NO: 869 - protein, 21 aa, Oryctolagus cuniculus
  misc_feature (8)..(8): Xaa can be lysine or homocitrulline
QIDVDVSXPDLTAALRDVRQQ

SEQ ID NO: 870 - protein, 21 aa, artificial
  Concensus sequence
  misc_feature (8)..(8): Xaa can be lysine or homocitrulline
QIDMDVSXPDLTAALRDVRQQ

SEQ ID NO: 871 - protein, 18 aa, Murine
  misc_feature (12)..(12): Xaa can be lysine or homocitrulline
DVRQQYESVAAXNLQEAE

SEQ ID NO: 872 - protein, 18 aa, Bos taurus
  misc_feature (12)..(12): Xaa can be lysine or homocitrulline
DVRQQYESVAAXNLQEAE

SEQ ID NO: 873 - protein, 18 aa, Sus scrofa
  misc_feature (12)..(12): Xaa can be lysine or homocitrulline
DVRQQYESVAAXNLQEAE

SEQ ID NO: 874 - protein, 18 aa, Equus caballus
  misc_feature (12)..(12): Xaa can be lysine or homocitrulline
DVRQQYESVAAXNLQEAE

SEQ ID NO: 875 - protein, 18 aa, Gallus gallus
  misc_feature (12)..(12): Xaa can be lysine or homocitrulline
DVRQQYESVAAXNLQEAE

SEQ ID NO: 876 - protein, 18 aa, Ovis aries
  misc_feature (12)..(12): Xaa can be lysine or homocitrulline
DVRQQYESVAAXNLQEAE

SEQ ID NO: 877 - protein, 18 aa, Canis lupus
  misc_feature (12)..(12): Xaa can be lysine or homocitrulline
DVRQQYESVAAXNLQEAE

SEQ ID NO: 878 - protein, 18 aa, Oryctolagus cuniculus
  misc_feature (12)..(12): Xaa can be lysine or homocitrulline
DVRQQYESVAAXNLQEAE

SEQ ID NO: 879 - protein, 18 aa, artificial
  Concensus sequence
  misc_feature (12)..(12): Xaa can be lysine or homocitrulline
DVRQQYESVAAXNLQEAE

SEQ ID NO: 880 - protein, 20 aa, Murine
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 881 - protein, 20 aa, Bos taurus
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 882 - protein, 20 aa, Sus scrofa
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 883 - protein, 20 aa, Equus caballus
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 884 - protein, 20 aa, Gallus gallus
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 885 - protein, 20 aa, Ovis aries
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 886 - protein, 20 aa, Canis lupus
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 887 - protein, 20 aa, Oryctolagus cuniculus
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 888 - protein, 20 aa, artificial
  Concensus sequence
  misc_feature (7)..(7): Xaa can be lysine or homocitrulline
  misc_feature (9)..(9): Xaa can be lysine or homocitrulline
EAEEWYXSXFADLSEAANRN

SEQ ID NO: 889 - protein, 18 aa, Murine
  misc_feature (7)..(7): Xaa can be lysine or homocitrulline
  misc_feature (9)..(9): Xaa can be lysine or homocitrulline
EAEEWYXSXFADLSEAAN

SEQ ID NO: 890 - protein, 18 aa, Bos taurus
  misc_feature (7)..(7): Xaa can be lysine or homocitrulline
  misc_feature (9)..(9): Xaa can be lysine or homocitrulline
EAEEWYXSXFADLSEAAN

SEQ ID NO: 891 - protein, 18 aa, Sus scrofa
  misc_feature (7)..(7): Xaa can be lysine or homocitrulline
  misc_feature (9)..(9): Xaa can be lysine or homocitrulline
EAEEWYXSXFADLSEAAN

SEQ ID NO: 892 - protein, 18 aa, Equus caballus
  misc_feature (7)..(7): Xaa can be lysine or homocitrulline
  misc_feature (9)..(9): Xaa can be lysine or homocitrulline
EAEEWYXSXFADLSEAAN

SEQ ID NO: 893 - protein, 18 aa, Gallus gallus
  misc_feature (7)..(7): Xaa can be lysine or homocitrulline
  misc_feature (9)..(9): Xaa can be lysine or homocitrulline
EAEEWYXSXFADLSEAAN

SEQ ID NO: 894 - protein, 18 aa, Ovis aries
  misc_feature (7)..(7): Xaa can be lysine or homocitrulline
  misc_feature (9)..(9): Xaa can be lysine or homocitrulline
EAEEWYXSXFADLSEAAN

SEQ ID NO: 895 - protein, 18 aa, Canis lupus
  misc_feature (7)..(7): Xaa can be lysine or homocitrulline
  misc_feature (9)..(9): Xaa can be lysine or homocitrulline
EAEEWYXSXFADLSEAAN

SEQ ID NO: 896 - protein, 18 aa, Oryctolagus cuniculus
  misc_feature (7)..(7): Xaa can be lysine or homocitrulline
  misc_feature (9)..(9): Xaa can be lysine or homocitrulline
EAEEWYXSXFADLSEAAN

SEQ ID NO: 897 - protein, 18 aa, artificial
  Concensus sequence
  misc_feature (7)..(7): Xaa can be lysine or homocitrulline
  misc_feature (9)..(9): Xaa can be lysine or homocitrulline
EAEEWYXSXFADLSEAAN

SEQ ID NO: 898 - protein, 19 aa, Murine
  misc_feature (1)..(1): Xaa can be lysine or homocitrulline
  misc_feature (13)..(13): Xaa can be lysine or homocitrulline
XMALDIEIATYRXLLEGEE

SEQ ID NO: 899 - protein, 19 aa, Bos taurus
  misc_feature (1)..(1): Xaa can be lysine or homocitrulline
  misc_feature (13)..(13): Xaa can be lysine or homocitrulline
XMALDIEIATYRXLLEGEE

SEQ ID NO: 900 - protein, 19 aa, Sus scrofa
  misc_feature (1)..(1): Xaa can be lysine or homocitrulline
  misc_feature (13)..(13): Xaa can be lysine or homocitrulline
XMALDIEIATYRXLLEGEE

SEQ ID NO: 901 - protein, 19 aa, Equus caballus
  misc_feature (1)..(1): Xaa can be lysine or homocitrulline
  misc_feature (13)..(13): Xaa can be lysine or homocitrulline
XMALDIEIATYRXLLEGEE

SEQ ID NO: 902 - protein, 19 aa, Gallus gallus
  misc_feature (1)..(1): Xaa can be lysine or homocitrulline
  misc_feature (13)..(13): Xaa can be lysine or homocitrulline
XMALDIEIATYRXLLEGEE

SEQ ID NO: 903 - protein, 19 aa, Ovis aries
  misc_feature (1)..(1): Xaa can be lysine or homocitrulline
  misc_feature (13)..(13): Xaa can be lysine or homocitrulline
XMALDIEIATYRXLLEGEE

SEQ ID NO: 904 - protein, 19 aa, Canis lupus
  misc_feature (1)..(1): Xaa can be lysine or homocitrulline
  misc_feature (13)..(13): Xaa can be lysine or homocitrulline
XMALDIEIATYRXLLEGEE

SEQ ID NO: 905 - protein, 19 aa, Oryctolagus cuniculus
  misc_feature (1)..(1): Xaa can be lysine or homocitrulline
  misc_feature (13)..(13): Xaa can be lysine or homocitrulline
XMALDIEIATYRXLLEGEE

SEQ ID NO: 906 - protein, 19 aa, artificial
  Concensus sequence
  misc_feature (1)..(1): Xaa can be lysine or homocitrulline
  misc_feature (13)..(13): Xaa can be lysine or homocitrulline
XMALDIEIATYRXLLEGEE

SEQ ID NO: 907 - protein, 20 aa, Murine
  misc_feature (14)..(14): Xaa can be lysine or homocitrulline
IGGVILFHETLYQXADDGRP

SEQ ID NO: 908 - protein, 20 aa, Bos taurus
  misc_feature (14)..(14): Xaa can be lysine or homocitrulline
IGGVILFHETLYQXADDGRP

SEQ ID NO: 909 - protein, 20 aa, Sus scrofa
  misc_feature (14)..(14): Xaa can be lysine or homocitrulline
IGGVILFHETLYQXADDGRP

SEQ ID NO: 910 - protein, 20 aa, Equus caballus
  misc_feature (14)..(14): Xaa can be lysine or homocitrulline
IGGVILFHETLYQXADDGRP

SEQ ID NO: 911 - protein, 20 aa, Felis catus
  misc_feature (14)..(14): Xaa can be lysine or homocitrulline
IGGVILFHETLYQXTDDGRP

SEQ ID NO: 912 - protein, 20 aa, Canis lupus
  misc_feature (14)..(14): Xaa can be lysine or homocitrulline
IGGVILFHETLYQXTDDGRP

SEQ ID NO: 913 - protein, 20 aa, Oryctolagus cuniculus
  misc_feature (14)..(14): Xaa can be lysine or homocitrulline
IGGVILFHETLYQXADDGRP

SEQ ID NO: 914 - protein, 20 aa, Ovis aries
  misc_feature (14)..(14): Xaa can be lysine or homocitrulline
IGGVILFHETLYQXADDGRP

SEQ ID NO: 915 - protein, 20 aa, artificial
  Concensus sequence
  misc_feature (14)..(14): Xaa can be lysine or homocitrulline
IGGVILFHETLYQXADDGRP

SEQ ID NO: 916 - protein, 18 aa, Murine
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 917 - protein, 18 aa, Bos taurus
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 918 - protein, 18 aa, Sus scrofa
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 919 - protein, 18 aa, Equus caballus
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 920 - protein, 18 aa, Felis catus
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 921 - protein, 18 aa, Canis lupus
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 922 - protein, 18 aa, Oryctolagus cuniculus
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 923 - protein, 18 aa, Ovis aries
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 924 - protein, 18 aa, artificial
  Concensus sequence
  misc_feature (1)..(1): Xaa can be lysine or homocitrulline
  misc_feature (8)..(8): Xaa can be lysine or homocitrulline
  misc_feature (14)..(14): Xaa can be lysine or homocitrulline
XDGADFAXWRCVLXIGEH

SEQ ID NO: 925 - protein, 19 aa, Murine
  misc_feature (3)..(3): Xaa can be lysine or homocitrulline
  misc_feature (11)..(11): Xaa can be lysine or homocitrulline
DLXRCQYVTEXVLAAVYRA

SEQ ID NO: 926 - protein, 19 aa, Bos taurus
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 927 - protein, 19 aa, Sus scrofa
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 928 - protein, 19 aa, Equus caballus
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 929 - protein, 19 aa, Felis catus
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 930 - protein, 19 aa, Canis lupus
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 931 - protein, 19 aa, Oryctolagus cuniculus
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 932 - protein, 19 aa, Ovis aries
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 933 - protein, 19 aa, artificial
  Concensus sequence
  misc_feature (3)..(3): Xaa can be lysine or homocitrulline
  misc_feature (11)..(11): Xaa can be lysine or homocitrulline
  misc_feature (18)..(18): Xaa can be lysine or homocitrulline
DLXRCQYVTEXVLAAVYXA

SEQ ID NO: 934 - protein, 19 aa, Murine
  misc_feature (1)..(1): Xaa can be lysine or homocitrulline
XVLAAVYRALSDHHVYLEG

SEQ ID NO: 935 - protein, 19 aa, Bos taurus
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 936 - protein, 19 aa, Sus scrofa
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 937 - protein, 19 aa, Equus caballus
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 938 - protein, 19 aa, Felis catus
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 939 - protein, 19 aa, Canis lupus
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 940 - protein, 19 aa, Oryctolagus cuniculus
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 941 - protein, 19 aa, Ovis aries
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 942 - protein, 19 aa, artificial
  Concensus sequence
  misc_feature (1)..(1): Xaa can be lysine or homocitrulline
  misc_feature (8)..(8): Xaa can be lysine or homocitrulline
XVLAAVYXALSDHHIYLEG

SEQ ID NO: 943 - protein, 19 aa, Murine
  misc_feature (14)..(14): Xaa can be lysine or homocitrulline
LSDHHVYLEGTLLXPNMVT

SEQ ID NO: 944 - protein, 19 aa, Bos taurus
  misc_feature (14)..(14): Xaa can be lysine or homocitrulline
LSDHHIYLEGTLLXPNMVT

SEQ ID NO: 945 - protein, 19 aa, Sus scrofa
  misc_feature (14)..(14): Xaa can be lysine or homocitrulline
LSDHHIYLEGTLLXPNMVT

SEQ ID NO: 946 - protein, 19 aa, Equus caballus
  misc_feature (14)..(14): Xaa can be lysine or homocitrulline
LSDHHIYLEGTLLXPNMVT

SEQ ID NO: 947 - protein, 19 aa, Felis catus
  misc_feature (14)..(14): Xaa can be lysine or homocitrulline
LSDHHIYLEGTLLXPNMVT

SEQ ID NO: 948 - protein, 19 aa, Canis lupus
  misc_feature (14)..(14): Xaa can be lysine or homocitrulline
LSDHHIYLEGTLLXPNMVT

SEQ ID NO: 949 - protein, 19 aa, Oryctolagus cuniculus
  misc_feature (14)..(14): Xaa can be lysine or homocitrulline
LSDHHIYLEGTLLXPNMVT

SEQ ID NO: 950 - protein, 19 aa, Ovis aries
  misc_feature (14)..(14): Xaa can be lysine or homocitrulline
LSDHHIYLEGTLLXPNMVT

SEQ ID NO: 951 - protein, 19 aa, artificial
  Concensus sequence
  misc_feature (14)..(14): Xaa can be lysine or homocitrulline
LSDHHIYLEGTLLXPNMVT

SEQ ID NO: 952 - protein, 19 aa, Bos taurus
  misc_feature (6)..(6): Xaa can be lysine or homocitrulline
HACTQXYSHEEIAMATVTA

SEQ ID NO: 953 - protein, 19 aa, Sus scrofa
  misc_feature (6)..(6): Xaa can be lysine or homocitrulline
HACTQXYSHEEIAMATVTA

SEQ ID NO: 954 - protein, 19 aa, Felis catus
  misc_feature (6)..(6): Xaa can be lysine or homocitrulline
HACTHXYSHEEIAMATVTA

SEQ ID NO: 955 - protein, 19 aa, Canis lupus
  misc_feature (6)..(6): Xaa can be lysine or homocitrulline
HACTHXYSHEEIAMATVTA

SEQ ID NO: 956 - protein, 19 aa, Oryctolagus cuniculus
  misc_feature (6)..(6): Xaa can be lysine or homocitrulline
HACTQXYSHEEIAMATVTA

SEQ ID NO: 957 - protein, 19 aa, Ovis aries
  misc_feature (6)..(6): Xaa can be lysine or homocitrulline
HACTQXYSHEEIAMATVTA

SEQ ID NO: 958 - protein, 19 aa, artificial
  Concensus sequence
  misc_feature (6)..(6): Xaa can be lysine or homocitrulline
HACTQXYSHEEIAMATVTA

SEQ ID NO: 959 - protein, 20 aa, Murine
  misc_feature (8)..(8): Xaa can be lysine or homocitrulline
  misc_feature (20)..(20): Xaa can be lysine or homocitrulline
AAQEEYIXRALANSLACQGX

SEQ ID NO: 960 - protein, 20 aa, Bos taurus
  misc_feature (8)..(8): Xaa can be lysine or homocitrulline
  misc_feature (20)..(20): Xaa can be lysine or homocitrulline
AAQEEYVXRALANSLACQGX

SEQ ID NO: 961 - protein, 20 aa, Sus scrofa
  misc_feature (8)..(8): Xaa can be lysine or homocitrulline
  misc_feature (20)..(20): Xaa can be lysine or homocitrulline
AAQEEYVXRALANSLACQGX

SEQ ID NO: 962 - protein, 20 aa, Equus caballus
  misc_feature (8)..(8): Xaa can be lysine or homocitrulline
  misc_feature (20)..(20): Xaa can be lysine or homocitrulline
AAQEEYVXRALANSLACQGX

SEQ ID NO: 963 - protein, 20 aa, Felis catus
  misc_feature (8)..(8): Xaa can be lysine or homocitrulline
  misc_feature (20)..(20): Xaa can be lysine or homocitrulline
AAQEEYVXRALANSLACQGX

SEQ ID NO: 964 - protein, 20 aa, Canis lupus
  misc_feature (8)..(8): Xaa can be lysine or homocitrulline
  misc_feature (20)..(20): Xaa can be lysine or homocitrulline
AAQEEYIXRALANSLACQGX

SEQ ID NO: 965 - protein, 20 aa, Oryctolagus cuniculus
  misc_feature (8)..(8): Xaa can be lysine or homocitrulline
  misc_feature (20)..(20): Xaa can be lysine or homocitrulline
AAQEEYVXRALANSLACQGX

SEQ ID NO: 966 - protein, 20 aa, Ovis aries
  misc_feature (8)..(8): Xaa can be lysine or homocitrulline
  misc_feature (20)..(20): Xaa can be lysine or homocitrulline
AAQEEYVXRALANSLACQGX

SEQ ID NO: 967 - protein, 20 aa, artificial
  Concensus sequence
  misc_feature (8)..(8): Xaa can be lysine or homocitrulline
  misc_feature (20)..(20): Xaa can be lysine or homocitrulline
AAQEEYVXRALANSLACQGX

SEQ ID NO: 968 - protein, 16 aa, Rattus rattus
  misc_feature (5)..(5): Xaa can be lysine or homocitrulline
MSILXIHAREIFDSRG

SEQ ID NO: 969 - protein, 16 aa, Bos taurus
  misc_feature (5)..(5): Xaa can be lysine or homocitrulline
MSILXVHAREIFDSRG

SEQ ID NO: 970 - protein, 16 aa, Sus scrofa
  misc_feature (5)..(5): Xaa can be lysine or homocitrulline
MSILXIHAREIFDSRG

SEQ ID NO: 971 - protein, 16 aa, Equus caballus
  misc_feature (5)..(5): Xaa can be lysine or homocitrulline
MSILXIHAREIFDSRG

SEQ ID NO: 972 - protein, 16 aa, Gallus gallus
  misc_feature (5)..(5): Xaa can be lysine or homocitrulline
MSILXIHAREIFDSRG

SEQ ID NO: 973 - protein, 16 aa, Felis catus
  misc_feature (5)..(5): Xaa can be lysine or homocitrulline
MSILXVHAREIFDSRG

SEQ ID NO: 974 - protein, 16 aa, Canis lupus
  misc_feature (5)..(5): Xaa can be lysine or homocitrulline
MSILXIHAREIFDSRG

SEQ ID NO: 975 - protein, 16 aa, Ovis aries
  misc_feature (5)..(5): Xaa can be lysine or homocitrulline
MSILXVHAREIFDSRG

SEQ ID NO: 976 - protein, 16 aa, artificial
  Concensus sequence
  misc_feature (5)..(5): Xaa can be lysine or homocitrulline
MSILXIHAREIFDSRG

SEQ ID NO: 977 - protein, 18 aa, Rattus rattus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRFMGXGVSXAVEHI

SEQ ID NO: 978 - protein, 18 aa, Bos taurus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 979 - protein, 18 aa, Sus scrofa
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 980 - protein, 18 aa, Equus caballus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 981 - protein, 18 aa, Felis catus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 982 - protein, 18 aa, Canis lupus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 983 - protein, 18 aa, Oryctolagus cuniculus
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 984 - protein, 18 aa, Ovis aries
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 985 - protein, 18 aa, artificial
  Concensus sequence
  misc_feature (3)..(3): Xaa can be lysine or homocitrulline
  misc_feature (9)..(9): Xaa can be lysine or homocitrulline
  misc_feature (13)..(13): Xaa can be lysine or homocitrulline
NDXTRYMGXGVSXAVEHI

SEQ ID NO: 986 - protein, 22 aa, Murine
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 987 - protein, 22 aa, Rattus rattus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 988 - protein, 22 aa, Bos taurus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 989 - protein, 22 aa, Sus scrofa
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 990 - protein, 22 aa, Equus caballus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 991 - protein, 22 aa, Gallus gallus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 992 - protein, 22 aa, Felis catus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 993 - protein, 22 aa, Canis lupus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 994 - protein, 22 aa, Oryctolagus cuniculus
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 995 - protein, 22 aa, Ovis aries
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 996 - protein, 22 aa, artificial
  Concensus sequence
  misc_feature (4)..(4): Xaa can be lysine or homocitrulline
  misc_feature (6)..(6): Xaa can be lysine or homocitrulline
  misc_feature (21)..(21): Xaa can be lysine or homocitrulline
TENXSXFGANAILGVSLAVCXA

SEQ ID NO: 997 - protein, 21 aa, Rattus rattus
  misc_feature (7)..(7): Xaa can be lysine or homocitrulline
GSHAGNXLAMQEFMILPVGAS

SEQ ID NO: 998 - protein, 21 aa, Bos taurus
  misc_feature (7)..(7): Xaa can be lysine or homocitrulline
GSHAGNXLAMQEFMILPVGAE

SEQ ID NO: 999 - protein, 21 aa, Equus caballus
  misc_feature (7)..(7): Xaa can be lysine or homocitrulline
GSHAGNXLAMQEFMILPVGAA

SEQ ID NO: 1000 - protein, 21 aa, Felis catus
  misc_feature (7)..(7): Xaa can be lysine or homocitrulline
GSHAGNXLAMQEFMILPVGAA

SEQ ID NO: 1001 - protein, 21 aa, Oryctolagus cuniculus
  misc_feature (7)..(7): Xaa can be lysine or homocitrulline
GSHAGNXLAMQEFMILPIGAA

SEQ ID NO: 1002 - protein, 21 aa, Ovis aries
  misc_feature (7)..(7): Xaa can be lysine or homocitrulline
GSHAGNXLAMQEFMILPVGAE

SEQ ID NO: 1003 - protein, 21 aa, artificial
  Concensus sequence
  misc_feature (7)..(7): Xaa can be lysine or homocitrulline
GSHAGNXLAMQEFMILPVGAA

SEQ ID NO: 1004 - protein, 19 aa, Murine
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1005 - protein, 19 aa, Rattus rattus
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1006 - protein, 19 aa, Bos taurus
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1007 - protein, 19 aa, Sus scrofa
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1008 - protein, 19 aa, Felis catus
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1009 - protein, 19 aa, Oryctolagus cuniculus
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1010 - protein, 19 aa, Ovis aries
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1011 - protein, 19 aa, artificial
  Concensus sequence
  misc_feature (15)..(15): Xaa can be lysine or homocitrulline
  misc_feature (19)..(19): Xaa can be lysine or homocitrulline
REAMRIGAEVYHNLXNVIX

SEQ ID NO: 1012 - protein, 19 aa, Murine
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1013 - protein, 19 aa, Rattus rattus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1014 - protein, 19 aa, Bos taurus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1015 - protein, 19 aa, Sus scrofa
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1016 - protein, 19 aa, Equus caballus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1017 - protein, 19 aa, Gallus gallus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1018 - protein, 19 aa, Felis catus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1019 - protein, 19 aa, Oryctolagus cuniculus
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1020 - protein, 19 aa, Ovis aries
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1021 - protein, 19 aa, artificial
  Concensus sequence
  misc_feature (4)..(4): Xaa can be lysine or homocitrulline
  misc_feature (6)..(6): Xaa can be lysine or homocitrulline
  misc_feature (9)..(9): Xaa can be lysine or homocitrulline
NVIXEXYGXDATNVGDEGG

SEQ ID NO: 1022 - protein, 20 aa, Murine
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 1023 - protein, 20 aa, Bos taurus
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 1024 - protein, 20 aa, Sus scrofa
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 1025 - protein, 20 aa, Equus caballus
  misc_feature (12)..(12): Xaa can be lysine or homocitrulline
  misc_feature (18)..(18): Xaa can be lysine or homocitrulline
DVAASEFFRSGXYDLDFXSP

SEQ ID NO: 1026 - protein, 20 aa, Felis catus
  misc_feature (12)..(12): Xaa can be lysine or homocitrulline
  misc_feature (18)..(18): Xaa can be lysine or homocitrulline
DVAASEFFRSGXYDLDFXSP

SEQ ID NO: 1027 - protein, 20 aa, Canis lupus
  misc_feature (12)..(12): Xaa can be lysine or homocitrulline
  misc_feature (18)..(18): Xaa can be lysine or homocitrulline
DVAASEFFRSGXYDLDFXSP

SEQ ID NO: 1028 - protein, 20 aa, Oryctolagus cuniculus
  misc_feature (12)..(12): Xaa can be lysine or homocitrulline
  misc_feature (18)..(18): Xaa can be lysine or homocitrulline
DVAASEFFRSGXYDLDFXSP

SEQ ID NO: 1029 - protein, 20 aa, Ovis aries
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 1030 - protein, 20 aa, artificial
  Concensus sequence
  misc_feature (12)..(12): Xaa can be lysine or homocitrulline
  misc_feature (18)..(18): Xaa can be lysine or homocitrulline
DVAASEFYRSGXYDLDFXSP

SEQ ID NO: 1031 - protein, 19 aa, Rattus rattus
  misc_feature (9)..(9): Xaa can be lysine or homocitrulline
  misc_feature (13)..(13): Xaa can be lysine or homocitrulline
PDQLADLYXSFIXDYPVVS

SEQ ID NO: 1032 - protein, 19 aa, Felis catus
  misc_feature (9)..(9): Xaa can be lysine or homocitrulline
PDELANLYXSFIRDYPVVS

SEQ ID NO: 1033 - protein, 19 aa, Canis lupus
  misc_feature (9)..(9): Xaa can be lysine or homocitrulline
PDQLADLYXSFIRDYPVVS

SEQ ID NO: 1034 - protein, 19 aa, artificial
  Concensus sequence
  misc_feature (9)..(9): Xaa can be lysine or homocitrulline
PDQLADLYXSFIRDYPVVS

SEQ ID NO: 1035 - protein, 17 aa, Murine
  misc_feature (6)..(6): Xaa can be lysine or homocitrulline
WGAWQXFTASAGIQVVG

SEQ ID NO: 1036 - protein, 17 aa, Equus caballus
  misc_feature (6)..(6): Xaa can be lysine or homocitrulline
WEAWQXFTASAGIQVVG

SEQ ID NO: 1037 - protein, 17 aa, Felis catus
  misc_feature (6)..(6): Xaa can be lysine or homocitrulline
WEAWQXFTASAGIQVVG

SEQ ID NO: 1038 - protein, 17 aa, Canis lupus
  misc_feature (6)..(6): Xaa can be lysine or homocitrulline
WEAWQXFTASAGIQVVG

SEQ ID NO: 1039 - protein, 17 aa, Oryctolagus cuniculus
  misc_feature (6)..(6): Xaa can be lysine or homocitrulline
WEAWQXFTASAGIQVVG

SEQ ID NO: 1040 - protein, 17 aa, Ovis aries
  misc_feature (6)..(6): Xaa can be lysine or homocitrulline
WEAWQXFTASAGIQVVG

SEQ ID NO: 1041 - protein, 17 aa, artificial
  Concensus sequence
  misc_feature (6)..(6): Xaa can be lysine or homocitrulline
WEAWQXFTASAGIQVVG

SEQ ID NO: 1042 - protein, 20 aa, Bos taurus
  misc_feature (3)..(3): Xaa can be lysine or homocitrulline
  misc_feature (11)..(11): Xaa can be lysine or homocitrulline
SEXSCNCLLLXVNQIGSVTE

SEQ ID NO: 1043 - protein, 20 aa, Equus caballus
  misc_feature (3)..(3): Xaa can be lysine or homocitrulline
  misc_feature (11)..(11): Xaa can be lysine or homocitrulline
GEXSCNCLLLXVNQIGSVTE

SEQ ID NO: 1044 - protein, 20 aa, Canis lupus
  misc_feature (3)..(3): Xaa can be lysine or homocitrulline
  misc_feature (11)..(11): Xaa can be lysine or homocitrulline
GEXSCNCLLLXVNQIGSVTE

SEQ ID NO: 1045 - protein, 20 aa, Ovis aries
  misc_feature (3)..(3): Xaa can be lysine or homocitrulline
  misc_feature (11)..(11): Xaa can be lysine or homocitrulline
SEXSCNCLLLXVNQIGSVTE

SEQ ID NO: 1046 - protein, 19 aa, artificial
  Concensus sequence
  misc_feature (2)..(2): Xaa can be lysine or homocitrulline
  misc_feature (10)..(10): Xaa can be lysine or homocitrulline
EXSCNCLLLXVNQIGSVTE

SEQ ID NO: 1047 - protein, 20 aa, Rattus rattus
  misc_feature (7)..(7): Xaa can be lysine or homocitrulline
RSERLAXYNQILRIEEELGS

SEQ ID NO: 1048 - protein, 20 aa, Bos taurus
  misc_feature (7)..(7): Xaa can be lysine or homocitrulline
RSERLAXYNQILRIEEELGS

SEQ ID NO: 1049 - protein, 20 aa, Sus scrofa
  misc_feature (7)..(7): Xaa can be lysine or homocitrulline
RSERLAXYNQILRIEEELGS

SEQ ID NO: 1050 - protein, 20 aa, Equus caballus
  misc_feature (7)..(7): Xaa can be lysine or homocitrulline
RSERLAXYNQILRIEEELGS

SEQ ID NO: 1051 - protein, 20 aa, Gallus gallus
  misc_feature (7)..(7): Xaa can be lysine or homocitrulline
RSERLAXYNQLLRIEEELGS

SEQ ID NO: 1052 - protein, 20 aa, Felis catus
  misc_feature (7)..(7): Xaa can be lysine or homocitrulline
RSERLAXYNQILRIEEELGS

SEQ ID NO: 1053 - protein, 20 aa, Canis lupus
  misc_feature (7)..(7): Xaa can be lysine or homocitrulline
RSERLAXYNQILRIEEELGS

SEQ ID NO: 1054 - protein, 20 aa, Oryctolagus cuniculus
  misc_feature (7)..(7): Xaa can be lysine or homocitrulline
RSERLAXYNQLLRIEEELGS

SEQ ID NO: 1055 - protein, 20 aa, Ovis aries
  misc_feature (7)..(7): Xaa can be lysine or homocitrulline
RSERLAXYNQILRIEEELGS

SEQ ID NO: 1056 - protein, 20 aa, artificial
  Concensus sequence
  misc_feature (7)..(7): Xaa can be lysine or homocitrulline
RSERLAXYNQILRIEEELGS

SEQ ID NO: 1057 - protein, 17 aa, Rattus rattus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 1058 - protein, 17 aa, Bos taurus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 1059 - protein, 17 aa, Sus scrofa
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRNFRNPLAX

SEQ ID NO: 1060 - protein, 17 aa, Equus caballus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRNFRNPLAX

SEQ ID NO: 1061 - protein, 17 aa, Felis catus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 1062 - protein, 17 aa, Canis lupus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 1063 - protein, 17 aa, Oryctolagus cuniculus
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRNFRNPLAX

SEQ ID NO: 1064 - protein, 17 aa, artificial
  Concensus sequence
  misc_feature (3)..(3): Xaa can be lysine or homocitrulline
  misc_feature (5)..(5): Xaa can be lysine or homocitrulline
  misc_feature (17)..(17): Xaa can be lysine or homocitrulline
GSXAXFAGRSFRNPLAX

SEQ ID NO: 1065 - protein, 21 aa, Murine
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1066 - protein, 21 aa, Rattus rattus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1067 - protein, 21 aa, Bos taurus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1068 - protein, 21 aa, Sus scrofa
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1069 - protein, 21 aa, Equus caballus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1070 - protein, 21 aa, Felis catus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1071 - protein, 21 aa, Canis lupus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1072 - protein, 21 aa, Oryctolagus cuniculus
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1073 - protein, 21 aa, Ovis aries
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1074 - protein, 21 aa, artificial
  Concensus sequence
  misc_feature (10)..(10): Xaa can be lysine or homocitrulline
  misc_feature (15)..(15): Xaa can be lysine or homocitrulline
  misc_feature (19)..(20): Xaa can be lysine or homocitrulline
NDPSVQQDIXFLPFXVVEXXT

SEQ ID NO: 1075 - protein, 16 aa, Murine
  misc_feature (9)..(9): Xaa can be lysine or homocitrulline
  misc_feature (11)..(11): Xaa can be lysine or homocitrulline
EISAMVLTXMXETAEA

SEQ ID NO: 1076 - protein, 16 aa, Rattus rattus
  misc_feature (9)..(9): Xaa can be lysine or homocitrulline
  misc_feature (11)..(11): Xaa can be lysine or homocitrulline
EISAMVLTXMXETAEA

SEQ ID NO: 1077 - protein, 16 aa, Bos taurus
  misc_feature (9)..(9): Xaa can be lysine or homocitrulline
  misc_feature (11)..(11): Xaa can be lysine or homocitrulline
EISAMVLTXMXETAEA

SEQ ID NO: 1078 - protein, 16 aa, Sus scrofa
  misc_feature (9)..(9): Xaa can be lysine or homocitrulline
  misc_feature (11)..(11): Xaa can be lysine or homocitrulline
EISAMVLTXMXETAEA

SEQ ID NO: 1079 - protein, 16 aa, Equus caballus
  misc_feature (9)..(9): Xaa can be lysine or homocitrulline
  misc_feature (11)..(11): Xaa can be lysine or homocitrulline
EISAMVLTXMXETAEA

SEQ ID NO: 1080 - protein, 16 aa, Gallus gallus
  misc_feature (9)..(9): Xaa can be lysine or homocitrulline
  misc_feature (11)..(11): Xaa can be lysine or homocitrulline
EISAMVLTXMXETAEA

SEQ ID NO: 1081 - protein, 16 aa, Felis catus
  misc_feature (9)..(9): Xaa can be lysine or homocitrulline
  misc_feature (11)..(11): Xaa can be lysine or homocitrulline
EISAMVLTXMXETAEA

SEQ ID NO: 1082 - protein, 16 aa, Canis lupus
  misc_feature (9)..(9): Xaa can be lysine or homocitrulline
  misc_feature (11)..(11): Xaa can be lysine or homocitrulline
EISAMVLTXMXETAEA

SEQ ID NO: 1083 - protein, 16 aa, Oryctolagus cuniculus
  misc_feature (9)..(9): Xaa can be lysine or homocitrulline
  misc_feature (11)..(11): Xaa can be lysine or homocitrulline
EISAMVLTXMXETAEA

SEQ ID NO: 1084 - protein, 16 aa, Ovis aries
  misc_feature (9)..(9): Xaa can be lysine or homocitrulline
  misc_feature (11)..(11): Xaa can be lysine or homocitrulline
EISAMVLTXMXETAEA

SEQ ID NO: 1085 - protein, 16 aa, artificial
  Concensus sequence
  misc_feature (9)..(9): Xaa can be lysine or homocitrulline
  misc_feature (11)..(11): Xaa can be lysine or homocitrulline
EISAMVLTXMXETAEA

SEQ ID NO: 1086 - protein, 21 aa, Murine
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1087 - protein, 21 aa, Rattus rattus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1088 - protein, 21 aa, Bos taurus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1089 - protein, 21 aa, Sus scrofa
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1090 - protein, 21 aa, Equus caballus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1091 - protein, 21 aa, Gallus gallus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1092 - protein, 21 aa, Felis catus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1093 - protein, 21 aa, Canis lupus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1094 - protein, 21 aa, Oryctolagus cuniculus
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1095 - protein, 21 aa, Ovis aries
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1096 - protein, 21 aa, artificial
  Concensus sequence
  misc_feature (14)..(14): Xaa can be lysine or homocitrulline
  misc_feature (17)..(19): Xaa can be lysine or homocitrulline
GEDFDQRVMEHFIXLYXXXTG

SEQ ID NO: 1097 - protein, 21 aa, Murine
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1098 - protein, 21 aa, Rattus rattus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1099 - protein, 21 aa, Bos taurus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1100 - protein, 21 aa, Sus scrofa
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1101 - protein, 21 aa, Equus caballus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1102 - protein, 21 aa, Gallus gallus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1103 - protein, 21 aa, Felis catus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1104 - protein, 21 aa, Canis lupus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1105 - protein, 21 aa, Oryctolagus cuniculus
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1106 - protein, 21 aa, Ovis aries
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1107 - protein, 21 aa, artificial
  Concensus sequence
  misc_feature (2)..(2): Xaa can be lysine or homocitrulline
  misc_feature (9)..(9): Xaa can be lysine or homocitrulline
  misc_feature (11)..(11): Xaa can be lysine or homocitrulline
QXLRREVEXAXRALSSQHQAR

SEQ ID NO: 1108 - protein, 21 aa, Murine
  misc_feature (11)..(11): Xaa can be lysine or homocitrulline
EDFSETLTRAXFEELNMDLFR

SEQ ID NO: 1109 - protein, 21 aa, Rattus rattus
  misc_feature (11)..(11): Xaa can be lysine or homocitrulline
EDFSETLTRAXFEELNMDLFR

SEQ ID NO: 1110 - protein, 21 aa, Bos taurus
  misc_feature (11)..(11): Xaa can be lysine or homocitrulline
EDFSETLTRAXFEELNMDLFR

SEQ ID NO: 1111 - protein, 21 aa, Sus scrofa
  misc_feature (11)..(11): Xaa can be lysine or homocitrulline
EDFSETLTRAXFEELNMDLFR

SEQ ID NO: 1112 - protein, 21 aa, Equus caballus
  misc_feature (11)..(11): Xaa can be lysine or homocitrulline
EDFSETLTRAXFEELNMDLFR

SEQ ID NO: 1113 - protein, 21 aa, Gallus gallus
  misc_feature (11)..(11): Xaa can be lysine or homocitrulline
EDFSETLTRAXFEELNMDLFR

SEQ ID NO: 1114 - protein, 21 aa, Felis catus
  misc_feature (11)..(11): Xaa can be lysine or homocitrulline
EDFSETLTRAXFEELNMDLFR

SEQ ID NO: 1115 - protein, 21 aa, Canis lupus
  misc_feature (11)..(11): Xaa can be lysine or homocitrulline
EDFSETLTRAXFEELNMDLFR

SEQ ID NO: 1116 - protein, 21 aa, Oryctolagus cuniculus
  misc_feature (11)..(11): Xaa can be lysine or homocitrulline
EDFSETLTRAXFEELNMDLFR

SEQ ID NO: 1117 - protein, 21 aa, Ovis aries
  misc_feature (11)..(11): Xaa can be lysine or homocitrulline
EDFSETLTRAXFEELNMDLFR

SEQ ID NO: 1118 - protein, 21 aa, artificial
  Concensus sequence
  misc_feature (11)..(11): Xaa can be lysine or homocitrulline
EDFSETLTRAXFEELNMDLFR

SEQ ID NO: 1119 - protein, 19 aa, Murine
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1120 - protein, 19 aa, Rattus rattus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1121 - protein, 19 aa, Bos taurus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1122 - protein, 19 aa, Sus scrofa
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1123 - protein, 19 aa, Equus caballus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1124 - protein, 19 aa, Gallus gallus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1125 - protein, 19 aa, Felis catus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1126 - protein, 19 aa, Canis lupus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1127 - protein, 19 aa, Oryctolagus cuniculus
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1128 - protein, 19 aa, Ovis aries
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1129 - protein, 19 aa, artificial
  Concensus sequence
  misc_feature (13)..(13): Xaa can be lysine or homocitrulline
  misc_feature (17)..(17): Xaa can be lysine or homocitrulline
EELNMDLFRSTMXPVQXVL

SEQ ID NO: 1130 - protein, 21 aa, Murine
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1131 - protein, 21 aa, Rattus rattus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1132 - protein, 21 aa, Bos taurus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1133 - protein, 21 aa, Sus scrofa
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1134 - protein, 21 aa, Equus caballus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1135 - protein, 21 aa, Gallus gallus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1136 - protein, 21 aa, Felis catus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1137 - protein, 21 aa, Canis lupus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1138 - protein, 21 aa, Oryctolagus cuniculus
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1139 - protein, 21 aa, Ovis aries
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1140 - protein, 21 aa, artificial
  Concensus sequence
  misc_feature (4)..(4): Xaa can be lysine or homocitrulline
  misc_feature (10)..(10): Xaa can be lysine or homocitrulline
  misc_feature (16)..(16): Xaa can be lysine or homocitrulline
RIPXIQQLVXEFFNGXEPSRG

SEQ ID NO: 1141 - protein, 21 aa, Murine
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1142 - protein, 21 aa, Rattus rattus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1143 - protein, 21 aa, Bos taurus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1144 - protein, 21 aa, Sus scrofa
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1145 - protein, 21 aa, Equus caballus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1146 - protein, 21 aa, Gallus gallus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1147 - protein, 21 aa, Felis catus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1148 - protein, 21 aa, Canis lupus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1149 - protein, 21 aa, Oryctolagus cuniculus
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1150 - protein, 21 aa, Ovis aries
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1151 - protein, 21 aa, artificial
  Concensus sequence
  misc_feature (5)..(5): Xaa can be lysine or homocitrulline
  misc_feature (15)..(15): Xaa can be lysine or homocitrulline
TVTIXVYEGERPLTXDNHLLG

SEQ ID NO: 1152 - protein, 18 aa, Murine
  misc_feature (12)..(12): Xaa can be lysine or homocitrulline
  misc_feature (18)..(18): Xaa can be lysine or homocitrulline
RNELESYAYSLXNQIGDX

SEQ ID NO: 1153 - protein, 18 aa, Rattus rattus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1154 - protein, 18 aa, Bos taurus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1155 - protein, 18 aa, Sus scrofa
  misc_feature (12)..(12): Xaa can be lysine or homocitrulline
  misc_feature (18)..(18): Xaa can be lysine or homocitrulline
RNELESYAYSLXNQIGDX

SEQ ID NO: 1156 - protein, 18 aa, Equus caballus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1157 - protein, 18 aa, Gallus gallus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1158 - protein, 18 aa, Felis catus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1159 - protein, 18 aa, Canis lupus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1160 - protein, 18 aa, Oryctolagus cuniculus
  misc_feature (12)..(12): Xaa can be lysine or homocitrulline
  misc_feature (18)..(18): Xaa can be lysine or homocitrulline
RNELESYAYSLXNQIGDX

SEQ ID NO: 1161 - protein, 18 aa, Ovis aries
  misc_feature (12)..(12): Xaa can be lysine or homocitrulline
  misc_feature (18)..(18): Xaa can be lysine or homocitrulline
RNELESYAYSLXNQIGDX

SEQ ID NO: 1162 - protein, 18 aa, artificial
  Concensus sequence
  misc_feature (12)..(12): Xaa can be lysine or homocitrulline
  misc_feature (18)..(18): Xaa can be lysine or homocitrulline
RNELESYAYSLXNQIGDX

SEQ ID NO: 1163 - protein, 20 aa, Rattus rattus
  misc_feature (1)..(2): Xaa can be lysine or homocitrulline
  misc_feature (14)..(14): Xaa can be lysine or homocitrulline
XXELEEIVQPIISXLYGSGG

SEQ ID NO: 1164 - protein, 20 aa, Bos taurus
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1165 - protein, 20 aa, Sus scrofa
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1166 - protein, 20 aa, Equus caballus
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1167 - protein, 20 aa, Felis catus
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1168 - protein, 20 aa, Canis lupus
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1169 - protein, 20 aa, Oryctolagus cuniculus
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1170 - protein, 20 aa, Ovis aries
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1171 - protein, 20 aa, artificial
  Concensus sequence
  misc_feature (1)..(2): Xaa can be lysine or homocitrulline
  misc_feature (14)..(14): Xaa can be lysine or homocitrulline
XXELEEIVQPIISXLYGSAG

SEQ ID NO: 1172 - protein, 18 aa, Murine
  misc_feature (7)..(7): Xaa can be lysine or homocitrulline
EPSQMLXHAVVNLINYQD

SEQ ID NO: 1173 - protein, 18 aa, Rattus rattus
  misc_feature (7)..(7): Xaa can be lysine or homocitrulline
EPSQMLXHAVVNLINYQD

SEQ ID NO: 1174 - protein, 18 aa, Bos taurus
  misc_feature (7)..(7): Xaa can be lysine or homocitrulline
EPSQMLXHAVVNLINYQD

SEQ ID NO: 1175 - protein, 18 aa, Sus scrofa
  misc_feature (7)..(7): Xaa can be lysine or homocitrulline
EPSQMLXHAVVNLINYQD

SEQ ID NO: 1176 - protein, 18 aa, Equus caballus
  misc_feature (7)..(7): Xaa can be lysine or homocitrulline
EPSQMLXHAVVNLINYQD

SEQ ID NO: 1177 - protein, 18 aa, Gallus gallus
  misc_feature (7)..(7): Xaa can be lysine or homocitrulline
EPSQMLXHAVVNLINYQD

SEQ ID NO: 1178 - protein, 18 aa, Felis catus
  misc_feature (7)..(7): Xaa can be lysine or homocitrulline
EPSQMLXHAVVNLINYQD

SEQ ID NO: 1179 - protein, 18 aa, Canis lupus
  misc_feature (7)..(7): Xaa can be lysine or homocitrulline
EPSQMLXHAVVNLINYQD

SEQ ID NO: 1180 - protein, 18 aa, Oryctolagus cuniculus
  misc_feature (7)..(7): Xaa can be lysine or homocitrulline
EPSQMLXHAVVNLINYQD

SEQ ID NO: 1181 - protein, 18 aa, Ovis aries
  misc_feature (7)..(7): Xaa can be lysine or homocitrulline
EPSQMLXHAVVNLINYQD

SEQ ID NO: 1182 - protein, 18 aa, artificial
  Concensus sequence
  misc_feature (7)..(7): Xaa can be lysine or homocitrulline
EPSQMLXHAVVNLINYQD

SEQ ID NO: 1183 - protein, 18 aa, Murine
  misc_feature (13)..(13): Xaa can be lysine or homocitrulline
TLHNLLLHQEGAXMAVRL

SEQ ID NO: 1184 - protein, 18 aa, Rattus rattus
  misc_feature (13)..(13): Xaa can be lysine or homocitrulline
TLHNLLLHQEGAXMAVRL

SEQ ID NO: 1185 - protein, 18 aa, Bos taurus
  misc_feature (13)..(13): Xaa can be lysine or homocitrulline
TLHNLLLHQEGAXMAVRL

SEQ ID NO: 1186 - protein, 18 aa, Sus scrofa
  misc_feature (13)..(13): Xaa can be lysine or homocitrulline
TLHNLLLHQEGAXMAVRL

SEQ ID NO: 1187 - protein, 18 aa, Equus caballus
  misc_feature (13)..(13): Xaa can be lysine or homocitrulline
TLHNLLLHQEGAXMAVRL

SEQ ID NO: 1188 - protein, 18 aa, Gallus gallus
  misc_feature (13)..(13): Xaa can be lysine or homocitrulline
TLHNLLLHQEGAXMAVRL

SEQ ID NO: 1189 - protein, 18 aa, Felis catus
  misc_feature (13)..(13): Xaa can be lysine or homocitrulline
TLHNLLLHQEGAXMAVRL

SEQ ID NO: 1190 - protein, 18 aa, Canis lupus
  misc_feature (13)..(13): Xaa can be lysine or homocitrulline
TLHNLLLHQEGAXMAVRL

SEQ ID NO: 1191 - protein, 18 aa, Oryctolagus cuniculus
  misc_feature (13)..(13): Xaa can be lysine or homocitrulline
TLHNLLLHQEGAXMAVRL

SEQ ID NO: 1192 - protein, 18 aa, Ovis aries
  misc_feature (13)..(13): Xaa can be lysine or homocitrulline
TLHNLLLHQEGAXMAVRL

SEQ ID NO: 1193 - protein, 18 aa, artificial
  Concensus sequence
  misc_feature (13)..(13): Xaa can be lysine or homocitrulline
TLHNLLLHQEGAXMAVRL

SEQ ID NO: 1194 - protein, 20 aa, Murine
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1195 - protein, 20 aa, Rattus rattus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1196 - protein, 20 aa, Bos taurus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1197 - protein, 20 aa, Sus scrofa
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1198 - protein, 20 aa, Equus caballus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1199 - protein, 20 aa, Gallus gallus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1200 - protein, 20 aa, Felis catus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1201 - protein, 20 aa, Canis lupus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1202 - protein, 20 aa, Oryctolagus cuniculus
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1203 - protein, 20 aa, Ovis aries
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1204 - protein, 20 aa, artificial
  Concensus sequence
  misc_feature (2)..(2): Xaa can be lysine or homocitrulline
  misc_feature (13)..(13): Xaa can be lysine or homocitrulline
  misc_feature (20)..(20): Xaa can be lysine or homocitrulline
AXMAVRLAGGLQXMVALLNX

SEQ ID NO: 1205 - protein, 20 aa, Murine
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1206 - protein, 20 aa, Rattus rattus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1207 - protein, 20 aa, Bos taurus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1208 - protein, 20 aa, Sus scrofa
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1209 - protein, 20 aa, Equus caballus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1210 - protein, 20 aa, Gallus gallus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1211 - protein, 20 aa, Felis catus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1212 - protein, 20 aa, Canis lupus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1213 - protein, 20 aa, Oryctolagus cuniculus
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1214 - protein, 20 aa, Ovis aries
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1215 - protein, 20 aa, artificial
  Concensus sequence
  misc_feature (1)..(1): Xaa can be lysine or homocitrulline
  misc_feature (5)..(5): Xaa can be lysine or homocitrulline
XTNVXFLAITTDCLQILAYG

SEQ ID NO: 1216 - protein, 18 aa, Murine
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1217 - protein, 18 aa, Rattus rattus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1218 - protein, 18 aa, Bos taurus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1219 - protein, 18 aa, Sus scrofa
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1220 - protein, 18 aa, Equus caballus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1221 - protein, 18 aa, Gallus gallus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1222 - protein, 18 aa, Felis catus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1223 - protein, 18 aa, Canis lupus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1224 - protein, 18 aa, Oryctolagus cuniculus
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1225 - protein, 18 aa, Ovis aries
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1226 - protein, 18 aa, artificial
  Concensus sequence
  misc_feature (4)..(4): Xaa can be lysine or homocitrulline
  misc_feature (14)..(14): Xaa can be lysine or homocitrulline
TYEXLLWTTSRVLXVLSV

SEQ ID NO: 1227 - protein, 21 aa, Murine
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1228 - protein, 21 aa, Rattus rattus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1229 - protein, 21 aa, Bos taurus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1230 - protein, 21 aa, Sus scrofa
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1231 - protein, 21 aa, Equus caballus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1232 - protein, 21 aa, Gallus gallus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1233 - protein, 21 aa, Felis catus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1234 - protein, 21 aa, Canis lupus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1235 - protein, 21 aa, Oryctolagus cuniculus
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1236 - protein, 21 aa, Ovis aries
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1237 - protein, 21 aa, artificial
  Concensus sequence
  misc_feature (2)..(2): Xaa can be lysine or homocitrulline
  misc_feature (12)..(12): Xaa can be lysine or homocitrulline
  misc_feature (21)..(21): Xaa can be lysine or homocitrulline
EXLLWTTSRVLXVLSVCSSNX

SEQ ID NO: 1238 - protein, 19 aa, Murine
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1239 - protein, 19 aa, Rattus rattus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1240 - protein, 19 aa, Bos taurus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1241 - protein, 19 aa, Sus scrofa
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1242 - protein, 19 aa, Equus caballus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1243 - protein, 19 aa, Gallus gallus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1244 - protein, 19 aa, Felis catus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1245 - protein, 19 aa, Canis lupus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1246 - protein, 19 aa, Oryctolagus cuniculus
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1247 - protein, 19 aa, Ovis aries
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1248 - protein, 19 aa, artificial
  Concensus sequence
  misc_feature (6)..(6): Xaa can be lysine or homocitrulline
  misc_feature (15)..(15): Xaa can be lysine or homocitrulline
TSRVLXVLSVCSSNXPAIV

SEQ ID NO: 1249 - protein, 18 aa, Murine
  misc_feature (8)..(8): Xaa can be lysine or homocitrulline
YGLPVVVXLLHPPSHWPL

SEQ ID NO: 1250 - protein, 18 aa, Rattus rattus
  misc_feature (8)..(8): Xaa can be lysine or homocitrulline
YGLPVVVXLLHPPSHWPL

SEQ ID NO: 1251 - protein, 18 aa, Bos taurus
  misc_feature (8)..(8): Xaa can be lysine or homocitrulline
YGLPVVVXLLHPPSHWPL

SEQ ID NO: 1252 - protein, 18 aa, Sus scrofa
  misc_feature (8)..(8): Xaa can be lysine or homocitrulline
YGLPVVVXLLHPPSHWPL

SEQ ID NO: 1253 - protein, 18 aa, Equus caballus
  misc_feature (8)..(8): Xaa can be lysine or homocitrulline
YGLPVVVXLLHPPSHWPL

SEQ ID NO: 1254 - protein, 18 aa, Gallus gallus
  misc_feature (8)..(8): Xaa can be lysine or homocitrulline
YGLPVVVXLLHPPSHWPL

SEQ ID NO: 1255 - protein, 18 aa, Felis catus
  misc_feature (8)..(8): Xaa can be lysine or homocitrulline
YGLPVVVXLLHPPSHWPL

SEQ ID NO: 1256 - protein, 18 aa, Canis lupus
  misc_feature (8)..(8): Xaa can be lysine or homocitrulline
YGLPVVVXLLHPPSHWPL

SEQ ID NO: 1257 - protein, 18 aa, Oryctolagus cuniculus
  misc_feature (8)..(8): Xaa can be lysine or homocitrulline
YGLPVVVXLLHPPSHWPL

SEQ ID NO: 1258 - protein, 18 aa, Ovis aries
  misc_feature (8)..(8): Xaa can be lysine or homocitrulline
YGLPVVVXLLHPPSHWPL

SEQ ID NO: 1259 - protein, 18 aa, artificial
  Concensus sequence
  misc_feature (8)..(8): Xaa can be lysine or homocitrulline
YGLPVVVXLLHPPSHWPL

SEQ ID NO: 1260 - protein, 20 aa, Murine
  misc_feature (6)..(6): Xaa can be lysine or homocitrulline
HWPLIXATVGLIRNLALCPA

SEQ ID NO: 1261 - protein, 20 aa, Rattus rattus
  misc_feature (6)..(6): Xaa can be lysine or homocitrulline
HWPLIXATVGLIRNLALCPA

SEQ ID NO: 1262 - protein, 20 aa, Bos taurus
  misc_feature (6)..(6): Xaa can be lysine or homocitrulline
HWPLIXATVGLIRNLALCPA

SEQ ID NO: 1263 - protein, 20 aa, Sus scrofa
  misc_feature (6)..(6): Xaa can be lysine or homocitrulline
HWPLIXATVGLIRNLALCPA

SEQ ID NO: 1264 - protein, 20 aa, Equus caballus
  misc_feature (6)..(6): Xaa can be lysine or homocitrulline
HWPLIXATVGLIRNLALCPA

SEQ ID NO: 1265 - protein, 20 aa, Gallus gallus
  misc_feature (6)..(6): Xaa can be lysine or homocitrulline
HWPLIXATVGLIRNLALCPA

SEQ ID NO: 1266 - protein, 20 aa, Felis catus
  misc_feature (6)..(6): Xaa can be lysine or homocitrulline
HWPLIXATVGLIRNLALCPA

SEQ ID NO: 1267 - protein, 20 aa, Canis lupus
  misc_feature (6)..(6): Xaa can be lysine or homocitrulline
HWPLIXATVGLIRNLALCPA

SEQ ID NO: 1268 - protein, 20 aa, Oryctolagus cuniculus
  misc_feature (6)..(6): Xaa can be lysine or homocitrulline
HWPLIXATVGLIRNLALCPA

SEQ ID NO: 1269 - protein, 20 aa, Ovis aries
  misc_feature (6)..(6): Xaa can be lysine or homocitrulline
HWPLIXATVGLIRNLALCPA

SEQ ID NO: 1270 - protein, 20 aa, artificial
  Concensus sequence
  misc_feature (6)..(6): Xaa can be lysine or homocitrulline
HWPLIXATVGLIRNLALCPA

SEQ ID NO: 1271 - protein, 19 aa, Murine
  misc_feature (19)..(19): Xaa can be lysine or homocitrulline
IENIQRVAAGVLCELAQDX

SEQ ID NO: 1272 - protein, 19 aa, Rattus rattus
  misc_feature (19)..(19): Xaa can be lysine or homocitrulline
IENIQRVAAGVLCELAQDX

SEQ ID NO: 1273 - protein, 19 aa, Bos taurus
  misc_feature (19)..(19): Xaa can be lysine or homocitrulline
IENIQRVAAGVLCELAQDX

SEQ ID NO: 1274 - protein, 19 aa, Sus scrofa
  misc_feature (19)..(19): Xaa can be lysine or homocitrulline
IENIQRVAAGVLCELAQDX

SEQ ID NO: 1275 - protein, 19 aa, Equus caballus
  misc_feature (19)..(19): Xaa can be lysine or homocitrulline
IENIQRVAAGVLCELAQDX

SEQ ID NO: 1276 - protein, 19 aa, Gallus gallus
  misc_feature (19)..(19): Xaa can be lysine or homocitrulline
IENIQRVAAGVLCELAQDX

SEQ ID NO: 1277 - protein, 19 aa, Felis catus
  misc_feature (19)..(19): Xaa can be lysine or homocitrulline
IENIQRVAAGVLCELAQDX

SEQ ID NO: 1278 - protein, 19 aa, Canis lupus
  misc_feature (19)..(19): Xaa can be lysine or homocitrulline
IENIQRVAAGVLCELAQDX

SEQ ID NO: 1279 - protein, 19 aa, Oryctolagus cuniculus
  misc_feature (19)..(19): Xaa can be lysine or homocitrulline
IENIQRVAAGVLCELAQDX

SEQ ID NO: 1280 - protein, 19 aa, Ovis aries
  misc_feature (19)..(19): Xaa can be lysine or homocitrulline
IENIQRVAAGVLCELAQDX

SEQ ID NO: 1281 - protein, 19 aa, artificial
  Concensus sequence
  misc_feature (19)..(19): Xaa can be lysine or homocitrulline
IENIQRVAAGVLCELAQDX

SEQ ID NO: 1282 - protein, 18 aa, Murine
  misc_feature (17)..(17): Xaa can be lysine or homocitrulline
GVATYAAAVLFRMSEDXP

SEQ ID NO: 1283 - protein, 18 aa, Rattus rattus
  misc_feature (17)..(17): Xaa can be lysine or homocitrulline
GVATYAAAVLFRMSEDXP

SEQ ID NO: 1284 - protein, 18 aa, Bos taurus
  misc_feature (17)..(17): Xaa can be lysine or homocitrulline
GVATYAAAVLFRMSEDXP

SEQ ID NO: 1285 - protein, 18 aa, Sus scrofa
  misc_feature (17)..(17): Xaa can be lysine or homocitrulline
GVATYAAAVLFRMSEDXP

SEQ ID NO: 1286 - protein, 18 aa, Equus caballus
  misc_feature (17)..(17): Xaa can be lysine or homocitrulline
GVATYAAAVLFRMSEDXP

SEQ ID NO: 1287 - protein, 18 aa, Gallus gallus
  misc_feature (17)..(17): Xaa can be lysine or homocitrulline
GVATYAAAVLFRMSEDXP

SEQ ID NO: 1288 - protein, 18 aa, Felis catus
  misc_feature (17)..(17): Xaa can be lysine or homocitrulline
GVATYAAAVLFRMSEDXP

SEQ ID NO: 1289 - protein, 18 aa, Canis lupus
  misc_feature (17)..(17): Xaa can be lysine or homocitrulline
GVATYAAAVLFRMSEDXP

SEQ ID NO: 1290 - protein, 18 aa, Oryctolagus cuniculus
  misc_feature (17)..(17): Xaa can be lysine or homocitrulline
GVATYAAAVLFRMSEDXP

SEQ ID NO: 1291 - protein, 18 aa, Ovis aries
  misc_feature (17)..(17): Xaa can be lysine or homocitrulline
GVATYAAAVLFRMSEVXP

SEQ ID NO: 1292 - protein, 18 aa, artificial
  Concensus sequence
  misc_feature (17)..(17): Xaa can be lysine or homocitrulline
GVATYAAAVLFRMSEDXP

SEQ ID NO: 1293 - protein, 20 aa, Murine
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXSLNNXFASFIDXVRFL

SEQ ID NO: 1294 - protein, 20 aa, Rattus rattus
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRFL

SEQ ID NO: 1295 - protein, 20 aa, Sus scrofa
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRHL

SEQ ID NO: 1296 - protein, 20 aa, Equus caballus
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRHL

SEQ ID NO: 1297 - protein, 20 aa, Oryctolagus cuniculus
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXSLNNXFASFIDXVRFL

SEQ ID NO: 1298 - protein, 20 aa, Ovis aries
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRHL

SEQ ID NO: 1299 - protein, 20 aa, artificial
  Concensus sequence
  misc_feature (4)..(4): Xaa can be lysine or homocitrulline
  misc_feature (9)..(9): Xaa can be lysine or homocitrulline
  misc_feature (16)..(16): Xaa can be lysine or homocitrulline
EQIXTLNNXFASFIDXVRHL

SEQ ID NO: 1300 - protein, 20 aa, Murine
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRFLEQQNXMLE

SEQ ID NO: 1301 - protein, 20 aa, Rattus rattus
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRFLEQQNXMLE

SEQ ID NO: 1302 - protein, 20 aa, Sus scrofa
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXVLE

SEQ ID NO: 1303 - protein, 20 aa, Canis lupus
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXILE

SEQ ID NO: 1304 - protein, 20 aa, Oryctolagus cuniculus
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRFLEQQNXMLE

SEQ ID NO: 1305 - protein, 20 aa, Ovis aries
  misc_feature (1)..(1): Xaa can be lysine or homocitrulline
  misc_feature (8)..(8): Xaa can be lysine or homocitrulline
  misc_feature (17)..(17): Xaa can be lysine or homocitrulline
XFASFIDXVRHLEQQNXVLE

SEQ ID NO: 1306 - protein, 20 aa, Murine
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXMLETXWSLLQQQXT

SEQ ID NO: 1307 - protein, 20 aa, Rattus rattus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXMLETXWSLLQQQXT

SEQ ID NO: 1308 - protein, 20 aa, Sus scrofa
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXVLETXWNLLQQQXT

SEQ ID NO: 1309 - protein, 20 aa, Oryctolagus cuniculus
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXMLETXWSLLQQQXT

SEQ ID NO: 1310 - protein, 20 aa, Ovis aries
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXVLETXWNLLQQQXT

SEQ ID NO: 1311 - protein, 20 aa, artificial
  Concensus sequence
  misc_feature (6)..(6): Xaa can be lysine or homocitrulline
  misc_feature (11)..(11): Xaa can be lysine or homocitrulline
  misc_feature (19)..(19): Xaa can be lysine or homocitrulline
LEQQNXMLETXWSLLQQQXT

SEQ ID NO: 1312 - protein, 21 aa, Rattus rattus
  misc_feature (3)..(3): Xaa can be lysine or homocitrulline
  misc_feature (11)..(11): Xaa can be lysine or homocitrulline
ETXWSLLQQQXTSRSNMDNMF

SEQ ID NO: 1313 - protein, 21 aa, Sus scrofa
  misc_feature (3)..(3): Xaa can be lysine or homocitrulline
  misc_feature (11)..(11): Xaa can be lysine or homocitrulline
ETXWNLLQQQXTARSNIDNMF

SEQ ID NO: 1314 - protein, 21 aa, Oryctolagus cuniculus
  misc_feature (3)..(3): Xaa can be lysine or homocitrulline
  misc_feature (11)..(11): Xaa can be lysine or homocitrulline
ETXWSLLQQQXTARSNMDNMF

SEQ ID NO: 1315 - protein, 21 aa, Ovis aries
  misc_feature (3)..(3): Xaa can be lysine or homocitrulline
  misc_feature (11)..(11): Xaa can be lysine or homocitrulline
ETXWNLLQQQXTARSNIDNMF

SEQ ID NO: 1316 - protein, 21 aa, artificial
  Concensus sequence
  misc_feature (3)..(3): Xaa can be lysine or homocitrulline
  misc_feature (11)..(11): Xaa can be lysine or homocitrulline
ETXWSLLQQQXTARSNMDNMF

SEQ ID NO: 1317 - protein, 21 aa, Murine
  misc_feature (4)..(4): Xaa can be lysine or homocitrulline
  misc_feature (16)..(17): Xaa can be lysine or homocitrulline
EINXRTEMENEFVLIXXDVDE

SEQ ID NO: 1318 - protein, 21 aa, Rattus rattus
  misc_feature (4)..(4): Xaa can be lysine or homocitrulline
  misc_feature (16)..(17): Xaa can be lysine or homocitrulline
EINXRTEMENEFVLIXXDVDE

SEQ ID NO: 1319 - protein, 21 aa, Sus scrofa
  misc_feature (4)..(4): Xaa can be lysine or homocitrulline
  misc_feature (16)..(17): Xaa can be lysine or homocitrulline
EIQXRTDMENEFVIIXXDVDE

SEQ ID NO: 1320 - protein, 21 aa, Oryctolagus cuniculus
  misc_feature (4)..(4): Xaa can be lysine or homocitrulline
  misc_feature (16)..(17): Xaa can be lysine or homocitrulline
EINXRTEMENEFVLIXXDVDE

SEQ ID NO: 1321 - protein, 21 aa, Ovis aries
  misc_feature (4)..(4): Xaa can be lysine or homocitrulline
  misc_feature (16)..(17): Xaa can be lysine or homocitrulline
EIQXRTDMENEFVIIXXDVDE

SEQ ID NO: 1322 - protein, 21 aa, artificial
  Concensus sequence
  misc_feature (4)..(4): Xaa can be lysine or homocitrulline
  misc_feature (16)..(17): Xaa can be lysine or homocitrulline
EINXRTEMENEFVLIXXDVDE

SEQ ID NO: 1323 - protein, 19 aa, Murine
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1324 - protein, 19 aa, Rattus rattus
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1325 - protein, 19 aa, Bos taurus
  misc_feature (8)..(9): Xaa can be lysine or homocitrulline
  misc_feature (18)..(18): Xaa can be lysine or homocitrulline
ENEFVIIXXDVDEAYMNXV

SEQ ID NO: 1326 - protein, 19 aa, Sus scrofa
  misc_feature (8)..(9): Xaa can be lysine or homocitrulline
  misc_feature (18)..(18): Xaa can be lysine or homocitrulline
ENEFVIIXXDVDEAYMNXV

SEQ ID NO: 1327 - protein, 19 aa, Equus caballus
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1328 - protein, 19 aa, Felis catus
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1329 - protein, 19 aa, Oryctolagus cuniculus
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1330 - protein, 19 aa, artificial
  Concensus sequence
  misc_feature (8)..(9): Xaa can be lysine or homocitrulline
  misc_feature (18)..(18): Xaa can be lysine or homocitrulline
ENEFVLIXXDVDEAYMNXV

SEQ ID NO: 1331 - protein, 17 aa, Murine
  misc_feature (2)..(2): Xaa can be lysine or homocitrulline
  misc_feature (11)..(11): Xaa can be lysine or homocitrulline
GXHGDDLRRTXTEISEM

SEQ ID NO: 1332 - protein, 17 aa, Bos taurus
  misc_feature (2)..(2): Xaa can be lysine or homocitrulline
  misc_feature (11)..(11): Xaa can be lysine or homocitrulline
GXHGDDLRRTXTEISEM

SEQ ID NO: 1333 - protein, 17 aa, Sus scrofa
  misc_feature (2)..(2): Xaa can be lysine or homocitrulline
  misc_feature (11)..(11): Xaa can be lysine or homocitrulline
GXHGDDLRRTXTEISEM

SEQ ID NO: 1334 - protein, 17 aa, Felis catus
  misc_feature (2)..(2): Xaa can be lysine or homocitrulline
  misc_feature (11)..(11): Xaa can be lysine or homocitrulline
GXHGDDLRRTXTEISEM

SEQ ID NO: 1335 - protein, 17 aa, Canis lupus
  misc_feature (2)..(2): Xaa can be lysine or homocitrulline
  misc_feature (11)..(11): Xaa can be lysine or homocitrulline
GXHGDDLRRTXTEISEM

SEQ ID NO: 1336 - protein, 17 aa, Oryctolagus cuniculus
  misc_feature (2)..(2): Xaa can be lysine or homocitrulline
  misc_feature (11)..(11): Xaa can be lysine or homocitrulline
GXHGDDLRRTXTEISEM

SEQ ID NO: 1337 - protein, 17 aa, Ovis aries
  misc_feature (2)..(2): Xaa can be lysine or homocitrulline
  misc_feature (11)..(11): Xaa can be lysine or homocitrulline
GXHGDDLRRTXTEISEM

SEQ ID NO: 1338 - protein, 17 aa, artificial
  Concensus sequence
  misc_feature (2)..(2): Xaa can be lysine or homocitrulline
  misc_feature (11)..(11): Xaa can be lysine or homocitrulline
GXHGDDLRRTXTEISEM

SEQ ID NO: 1339 - protein, 19 aa, Bos taurus
  misc_feature (6)..(6): Xaa can be lysine or homocitrulline
EIEGLXGQRASLEAAIADA

SEQ ID NO: 1340 - protein, 19 aa, Sus scrofa
  misc_feature (6)..(6): Xaa can be lysine or homocitrulline
EIEGLXGQRASLEAAIADA

SEQ ID NO: 1341 - protein, 19 aa, Ovis aries
  misc_feature (6)..(6): Xaa can be lysine or homocitrulline
EIEGLXGQRASLEAAIADA

SEQ ID NO: 1342 - protein, 19 aa, artificial
  Concensus sequence
  misc_feature (6)..(6): Xaa can be lysine or homocitrulline
EIEGLXGQRASLEAAIADA

SEQ ID NO: 1343 - protein, 20 aa, Canis lupus
  misc_feature (9)..(9): Xaa can be lysine or homocitrulline
  misc_feature (14)..(14): Xaa can be lysine or homocitrulline
EQRGELAVXDANAXVAELEA

SEQ ID NO: 1344 - protein, 20 aa, Ovis aries
  misc_feature (9)..(9): Xaa can be lysine or homocitrulline
  misc_feature (14)..(14): Xaa can be lysine or homocitrulline
EQRGEMAVXDAQAXLAELEA

SEQ ID NO: 1345 - protein, 20 aa, Murine
  misc_feature (13)..(13): Xaa can be lysine or homocitrulline
RQLREYQELMNVXLALDIEI

SEQ ID NO: 1346 - protein, 20 aa, Rattus rattus
  misc_feature (13)..(13): Xaa can be lysine or homocitrulline
RQLREYQELMNVXLALDIEI

SEQ ID NO: 1347 - protein, 20 aa, Sus scrofa
  misc_feature (13)..(13): Xaa can be lysine or homocitrulline
RQLREYQELMNVXLALDVEI

SEQ ID NO: 1348 - protein, 20 aa, Equus caballus
  misc_feature (13)..(13): Xaa can be lysine or homocitrulline
RQLREYQELMNVXLALDVEI

SEQ ID NO: 1349 - protein, 20 aa, Gallus gallus
  misc_feature (13)..(13): Xaa can be lysine or homocitrulline
RQLREYQELMNVXLALDIEI

SEQ ID NO: 1350 - protein, 20 aa, Felis catus
  misc_feature (13)..(13): Xaa can be lysine or homocitrulline
RQLREYQELMNVXLALDIEI

SEQ ID NO: 1351 - protein, 20 aa, Canis lupus
  misc_feature (13)..(13): Xaa can be lysine or homocitrulline
RQLREYQELMNVXLALDIEI

SEQ ID NO: 1352 - protein, 20 aa, Oryctolagus cuniculus
  misc_feature (13)..(13): Xaa can be lysine or homocitrulline
RQLREYQELMNVXLALDIEI

SEQ ID NO: 1353 - protein, 20 aa, Ovis aries
  misc_feature (13)..(13): Xaa can be lysine or homocitrulline
RQLREYQELMNVXLALDVEI

SEQ ID NO: 1354 - protein, 20 aa, artificial
  Concensus sequence
  misc_feature (13)..(13): Xaa can be lysine or homocitrulline
RQLREYQELMNVXLALDIEI

SEQ ID NO: 1355 - protein, 18 aa, Murine
  misc_feature (11)..(11): Xaa can be lysine or homocitrulline
LREYQELMNVXLALDIEI

SEQ ID NO: 1356 - protein, 18 aa, Rattus rattus
  misc_feature (11)..(11): Xaa can be lysine or homocitrulline
LREYQELMNVXLALDIEI

SEQ ID NO: 1357 - protein, 18 aa, Bos taurus
  misc_feature (11)..(11): Xaa can be lysine or homocitrulline
LREYQELMNVXLALDVEI

SEQ ID NO: 1358 - protein, 18 aa, Sus scrofa
  misc_feature (11)..(11): Xaa can be lysine or homocitrulline
LREYQELMNVXLALDVEI

SEQ ID NO: 1359 - protein, 18 aa, Equus caballus
  misc_feature (11)..(11): Xaa can be lysine or homocitrulline
LREYQELMNVXLALDVEI

SEQ ID NO: 1360 - protein, 18 aa, Gallus gallus
  misc_feature (11)..(11): Xaa can be lysine or homocitrulline
LREYQELMNVXLALDIEI

SEQ ID NO: 1361 - protein, 18 aa, Felis catus
  misc_feature (11)..(11): Xaa can be lysine or homocitrulline
LREYQELMNVXLALDIEI

SEQ ID NO: 1362 - protein, 18 aa, Canis lupus
  misc_feature (11)..(11): Xaa can be lysine or homocitrulline
LREYQELMNVXLALDIEI

SEQ ID NO: 1363 - protein, 18 aa, Oryctolagus cuniculus
  misc_feature (11)..(11): Xaa can be lysine or homocitrulline
LREYQELMNVXLALDIEI

SEQ ID NO: 1364 - protein, 18 aa, Ovis aries
  misc_feature (11)..(11): Xaa can be lysine or homocitrulline
LREYQELMNVXLALDVEI

SEQ ID NO: 1365 - protein, 18 aa, artificial
  Concensus sequence
  misc_feature (11)..(11): Xaa can be lysine or homocitrulline
LREYQELMNVXLALDIEI

SEQ ID NO: 1366 - protein, 19 aa, Rattus rattus
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1367 - protein, 19 aa, Sus scrofa
  misc_feature (1)..(1): Xaa can be lysine or homocitrulline
  misc_feature (13)..(13): Xaa can be lysine or homocitrulline
XLALDVEIATYRXLLEGEE

SEQ ID NO: 1368 - protein, 19 aa, Equus caballus
  misc_feature (1)..(1): Xaa can be lysine or homocitrulline
  misc_feature (13)..(13): Xaa can be lysine or homocitrulline
XLALDVEIATYRXLLEGEE

SEQ ID NO: 1369 - protein, 19 aa, Gallus gallus
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1370 - protein, 19 aa, Felis catus
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1371 - protein, 19 aa, Canis lupus
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1372 - protein, 19 aa, Oryctolagus cuniculus
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1373 - protein, 19 aa, Ovis aries
  misc_feature (1)..(1): Xaa can be lysine or homocitrulline
  misc_feature (13)..(13): Xaa can be lysine or homocitrulline
XLALDVEIATYRXLLEGEE

SEQ ID NO: 1374 - protein, 19 aa, artificial
  Concensus sequence
  misc_feature (1)..(1): Xaa can be lysine or homocitrulline
  misc_feature (13)..(13): Xaa can be lysine or homocitrulline
XLALDIEIATYRXLLEGEE

SEQ ID NO: 1375 - protein, 17 aa, Murine
  misc_feature (14)..(14): Xaa can be lysine or homocitrulline
  misc_feature (17)..(17): Xaa can be lysine or homocitrulline
PLRPQNYLFGCELXADX

SEQ ID NO: 1376 - protein, 17 aa, Rattus rattus
  misc_feature (14)..(14): Xaa can be lysine or homocitrulline
  misc_feature (17)..(17): Xaa can be lysine or homocitrulline
PLRPQNYLFGCELXADX

SEQ ID NO: 1377 - protein, 17 aa, Sus scrofa
  misc_feature (14)..(14): Xaa can be lysine or homocitrulline
  misc_feature (17)..(17): Xaa can be lysine or homocitrulline
PLRPQNYLFGCELXADX

SEQ ID NO: 1378 - protein, 17 aa, Equus caballus
  misc_feature (14)..(14): Xaa can be lysine or homocitrulline
  misc_feature (17)..(17): Xaa can be lysine or homocitrulline
PLRPQNYLFGCELXADX

SEQ ID NO: 1379 - protein, 17 aa, Felis catus
  misc_feature (14)..(14): Xaa can be lysine or homocitrulline
  misc_feature (17)..(17): Xaa can be lysine or homocitrulline
PLRPQNYLFGCELXADX

SEQ ID NO: 1380 - protein, 17 aa, Canis lupus
  misc_feature (14)..(14): Xaa can be lysine or homocitrulline
  misc_feature (17)..(17): Xaa can be lysine or homocitrulline
PLRPQNYLFGCELXADX

SEQ ID NO: 1381 - protein, 17 aa, Oryctolagus cuniculus
  misc_feature (14)..(14): Xaa can be lysine or homocitrulline
  misc_feature (17)..(17): Xaa can be lysine or homocitrulline
PLRPQNYLFGCELXADX

SEQ ID NO: 1382 - protein, 17 aa, Ovis aries
  misc_feature (14)..(14): Xaa can be lysine or homocitrulline
PLRPQNYLFGCELXADR

SEQ ID NO: 1383 - protein, 17 aa, artificial
  Concensus sequence
  misc_feature (14)..(14): Xaa can be lysine or homocitrulline
  misc_feature (17)..(17): Xaa can be lysine or homocitrulline
PLRPQNYLFGCELXADX

SEQ ID NO: 1384 - protein, 22 aa, Murine
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1385 - protein, 22 aa, Rattus rattus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1386 - protein, 22 aa, Bos taurus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1387 - protein, 22 aa, Sus scrofa
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1388 - protein, 22 aa, Equus caballus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1389 - protein, 22 aa, Felis catus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1390 - protein, 22 aa, Canis lupus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1391 - protein, 22 aa, Oryctolagus cuniculus
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1392 - protein, 22 aa, Ovis aries
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1393 - protein, 22 aa, artificial
  Concensus sequence
  misc_feature (6)..(6): Xaa can be lysine or homocitrulline
  misc_feature (13)..(13): Xaa can be lysine or homocitrulline
EGSPIXVTLATLXMSVQPTVSL

SEQ ID NO: 1394 - protein, 21 aa, Rattus rattus
  misc_feature (6)..(6): Xaa can be lysine or homocitrulline
  misc_feature (13)..(13): Xaa can be lysine or homocitrulline
DEEDVXLLGMSGXRSAPGGGN

SEQ ID NO: 1395 - protein, 21 aa, Sus scrofa
  misc_feature (6)..(6): Xaa can be lysine or homocitrulline
  misc_feature (13)..(13): Xaa can be lysine or homocitrulline
EEEDVXLLSISGXRSAPGGGS

SEQ ID NO: 1396 - protein, 21 aa, Felis catus
  misc_feature (6)..(6): Xaa can be lysine or homocitrulline
  misc_feature (13)..(13): Xaa can be lysine or homocitrulline
EEEDVXLLSISGXRSAPGSGS

SEQ ID NO: 1397 - protein, 21 aa, Canis lupus
  misc_feature (6)..(6): Xaa can be lysine or homocitrulline
  misc_feature (13)..(13): Xaa can be lysine or homocitrulline
EEEDVXLLSISGXRSAPGSGS

SEQ ID NO: 1398 - protein, 21 aa, Oryctolagus cuniculus
  misc_feature (6)..(6): Xaa can be lysine or homocitrulline
  misc_feature (13)..(13): Xaa can be lysine or homocitrulline
EEEDVXLLSISGXRSAPGGGS

SEQ ID NO: 1399 - protein, 21 aa, Ovis aries
  misc_feature (6)..(6): Xaa can be lysine or homocitrulline
  misc_feature (13)..(13): Xaa can be lysine or homocitrulline
EEEEVXLLSISGXRSAPGSGS

SEQ ID NO: 1400 - protein, 21 aa, artificial
  Concensus sequence
  misc_feature (6)..(6): Xaa can be lysine or homocitrulline
  misc_feature (13)..(13): Xaa can be lysine or homocitrulline
EEEDVXLLSISGXRSAPGGGS

SEQ ID NO: 1401 - protein, 19 aa, Murine
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1402 - protein, 19 aa, Rattus rattus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1403 - protein, 19 aa, Bos taurus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
SXGQESFXXQEXTPXTPRG

SEQ ID NO: 1404 - protein, 19 aa, Sus scrofa
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1405 - protein, 19 aa, Equus caballus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1406 - protein, 19 aa, Felis catus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1407 - protein, 19 aa, Oryctolagus cuniculus
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1408 - protein, 19 aa, Ovis aries
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1409 - protein, 19 aa, artificial
  Concensus sequence
  misc_feature (2)..(2): Xaa can be lysine or homocitrulline
  misc_feature (8)..(9): Xaa can be lysine or homocitrulline
  misc_feature (12)..(12): Xaa can be lysine or homocitrulline
  misc_feature (15)..(15): Xaa can be lysine or homocitrulline
  misc_feature (18)..(18): Xaa can be lysine or homocitrulline
SXGQESFXXQEXTPXTPXG

SEQ ID NO: 1410 - protein, 20 aa, Murine
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1411 - protein, 20 aa, Rattus rattus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1412 - protein, 20 aa, Bos taurus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1413 - protein, 20 aa, Sus scrofa
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1414 - protein, 20 aa, Equus caballus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1415 - protein, 20 aa, Felis catus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1416 - protein, 20 aa, Canis lupus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1417 - protein, 20 aa, Oryctolagus cuniculus
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1418 - protein, 20 aa, Ovis aries
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1419 - protein, 20 aa, artificial
  Concensus sequence
  misc_feature (6)..(6): Xaa can be lysine or homocitrulline
  misc_feature (10)..(10): Xaa can be lysine or homocitrulline
  misc_feature (16)..(16): Xaa can be lysine or homocitrulline
GGSLPXVEAXFINYVXNCFR

SEQ ID NO: 1420 - protein, 22 aa, Murine
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1421 - protein, 22 aa, Rattus rattus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1422 - protein, 22 aa, Bos taurus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1423 - protein, 22 aa, Sus scrofa
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1424 - protein, 22 aa, Equus caballus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1425 - protein, 22 aa, Felis catus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1426 - protein, 22 aa, Canis lupus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1427 - protein, 22 aa, Oryctolagus cuniculus
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1428 - protein, 22 aa, Ovis aries
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1429 - protein, 22 aa, artificial
  Concensus sequence
  misc_feature (2)..(2): Xaa can be lysine or homocitrulline
  misc_feature (8)..(8): Xaa can be lysine or homocitrulline
AXFINYVXNCFRMTDQEAIQDL

SEQ ID NO: 1430 - protein, 20 aa, Murine
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1431 - protein, 20 aa, Rattus rattus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1432 - protein, 20 aa, Bos taurus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1433 - protein, 20 aa, Sus scrofa
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1434 - protein, 20 aa, Equus caballus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1435 - protein, 20 aa, Gallus gallus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1436 - protein, 20 aa, Felis catus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1437 - protein, 20 aa, Canis lupus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1438 - protein, 20 aa, Oryctolagus cuniculus
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1439 - protein, 20 aa, Ovis aries
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1440 - protein, 20 aa, artificial
  Concensus sequence
  misc_feature (4)..(4): Xaa can be lysine or homocitrulline
  misc_feature (6)..(6): Xaa can be lysine or homocitrulline
  misc_feature (8)..(8): Xaa can be lysine or homocitrulline
  misc_feature (13)..(13): Xaa can be lysine or homocitrulline
IDLXDXYXNIGAXLVQDVAN

SEQ ID NO: 1441 - protein, 20 aa, Murine
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1442 - protein, 20 aa, Rattus rattus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1443 - protein, 20 aa, Bos taurus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1444 - protein, 20 aa, Equus caballus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1445 - protein, 20 aa, Felis catus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1446 - protein, 20 aa, Canis lupus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1447 - protein, 20 aa, Oryctolagus cuniculus
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1448 - protein, 20 aa, Ovis aries
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1449 - protein, 20 aa, artificial
  Concensus sequence
  misc_feature (9)..(9): Xaa can be lysine or homocitrulline
  misc_feature (14)..(14): Xaa can be lysine or homocitrulline
  misc_feature (17)..(17): Xaa can be lysine or homocitrulline
TVLARSIAXEGFEXISXGAN

SEQ ID NO: 1450 - protein, 19 aa, Murine
  misc_feature (11)..(11): Xaa can be lysine or homocitrulline
NDELEIIEGMXFDRGYISP

SEQ ID NO: 1451 - protein, 19 aa, Rattus rattus
  misc_feature (11)..(11): Xaa can be lysine or homocitrulline
NDELEIIEGMXFDRGYISP

SEQ ID NO: 1452 - protein, 19 aa, Bos taurus
  misc_feature (11)..(11): Xaa can be lysine or homocitrulline
NDELEIIEGMXFDRGYISP

SEQ ID NO: 1453 - protein, 19 aa, Sus scrofa
  misc_feature (11)..(11): Xaa can be lysine or homocitrulline
NDELEIIEGMXLYRGYISP

SEQ ID NO: 1454 - protein, 19 aa, Equus caballus
  misc_feature (11)..(11): Xaa can be lysine or homocitrulline
NDELEIIEGMXFDRGYISP

SEQ ID NO: 1455 - protein, 19 aa, Gallus gallus
  misc_feature (11)..(11): Xaa can be lysine or homocitrulline
NDELEIIEGMXFDRGYISP

SEQ ID NO: 1456 - protein, 19 aa, Felis catus
  misc_feature (11)..(11): Xaa can be lysine or homocitrulline
NDELEIIEGMXFDRGYISP

SEQ ID NO: 1457 - protein, 19 aa, Canis lupus
  misc_feature (11)..(11): Xaa can be lysine or homocitrulline
NDELEIIEGMXFDRGYISP

SEQ ID NO: 1458 - protein, 19 aa, Oryctolagus cuniculus
  misc_feature (11)..(11): Xaa can be lysine or homocitrulline
NDELEIIEGMXFDRGYISP

SEQ ID NO: 1459 - protein, 19 aa, Ovis aries
  misc_feature (11)..(11): Xaa can be lysine or homocitrulline
NDELEIIEGMXFDRGYISP

SEQ ID NO: 1460 - protein, 19 aa, artificial
  Concensus sequence
  misc_feature (11)..(11): Xaa can be lysine or homocitrulline
NDELEIIEGMXFDRGYISP

SEQ ID NO: 1461 - protein, 20 aa, Murine
  misc_feature (13)..(13): Xaa can be lysine or homocitrulline
GEALSTLVLNRLXVGLQVVA

SEQ ID NO: 1462 - protein, 20 aa, Rattus rattus
  misc_feature (13)..(13): Xaa can be lysine or homocitrulline
GEALSTLVLNRLXVGLQVVA

SEQ ID NO: 1463 - protein, 20 aa, Bos taurus
  misc_feature (13)..(13): Xaa can be lysine or homocitrulline
GEALSTLVLNRLXVGLQVVA

SEQ ID NO: 1464 - protein, 20 aa, Sus scrofa
  misc_feature (13)..(13): Xaa can be lysine or homocitrulline
GEALSTLVLNRLXVGLQVVA

SEQ ID NO: 1465 - protein, 20 aa, Equus caballus
  misc_feature (13)..(13): Xaa can be lysine or homocitrulline
GEALSTLVLNRLXVGLQVVA

SEQ ID NO: 1466 - protein, 20 aa, Gallus gallus
  misc_feature (13)..(13): Xaa can be lysine or homocitrulline
GEALSTLVLNRLXVGLQVVA

SEQ ID NO: 1467 - protein, 20 aa, Felis catus
  misc_feature (13)..(13): Xaa can be lysine or homocitrulline
GEALSTLVLNRLXVGLQVVA

SEQ ID NO: 1468 - protein, 20 aa, Canis lupus
  misc_feature (13)..(13): Xaa can be lysine or homocitrulline
GEALSTLVLNRLXVGLQVVA

SEQ ID NO: 1469 - protein, 20 aa, Oryctolagus cuniculus
  misc_feature (13)..(13): Xaa can be lysine or homocitrulline
GEALSTLVLNRLXVGLQVVA

SEQ ID NO: 1470 - protein, 20 aa, Ovis aries
  misc_feature (13)..(13): Xaa can be lysine or homocitrulline
GEALSTLVLNRLXVGLQVVA

SEQ ID NO: 1471 - protein, 20 aa, artificial
  Concensus sequence
  misc_feature (13)..(13): Xaa can be lysine or homocitrulline
GEALSTLVLNRLXVGLQVVA

SEQ ID NO: 1472 - protein, 20 aa, Rattus rattus
  misc_feature (14)..(14): Xaa can be lysine or homocitrulline
  misc_feature (16)..(16): Xaa can be lysine or homocitrulline
ITEQLDITTSEYEXEXLNER

SEQ ID NO: 1473 - protein, 20 aa, Sus scrofa
  misc_feature (14)..(14): Xaa can be lysine or homocitrulline
  misc_feature (16)..(16): Xaa can be lysine or homocitrulline
IIEQLDVTTSEYEXEXLNER

SEQ ID NO: 1474 - protein, 20 aa, Equus caballus
  misc_feature (14)..(14): Xaa can be lysine or homocitrulline
  misc_feature (16)..(16): Xaa can be lysine or homocitrulline
IIEQLDVTTSEYEXEXLNER

SEQ ID NO: 1475 - protein, 20 aa, Felis catus
  misc_feature (14)..(14): Xaa can be lysine or homocitrulline
  misc_feature (16)..(16): Xaa can be lysine or homocitrulline
IIEQLDITTSEYEXEXLNER

SEQ ID NO: 1476 - protein, 20 aa, Canis lupus
  misc_feature (14)..(14): Xaa can be lysine or homocitrulline
  misc_feature (16)..(16): Xaa can be lysine or homocitrulline
IIEQLDITTSEYEXEXLNER

SEQ ID NO: 1477 - protein, 20 aa, Oryctolagus cuniculus
  misc_feature (14)..(14): Xaa can be lysine or homocitrulline
  misc_feature (16)..(16): Xaa can be lysine or homocitrulline
IIEQLDITTSEYEXEXLNER

SEQ ID NO: 1478 - protein, 20 aa, Ovis aries
  misc_feature (14)..(14): Xaa can be lysine or homocitrulline
  misc_feature (16)..(16): Xaa can be lysine or homocitrulline
IIEQLDVTTSEYEXEXLNER

SEQ ID NO: 1479 - protein, 20 aa, artificial
  Concensus sequence
  misc_feature (14)..(14): Xaa can be lysine or homocitrulline
  misc_feature (16)..(16): Xaa can be lysine or homocitrulline
IIEQLDITTSEYEXEXLNER

SEQ ID NO: 1480 - protein, 18 aa, Murine
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1481 - protein, 18 aa, Rattus rattus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1482 - protein, 18 aa, Bos taurus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1483 - protein, 18 aa, Sus scrofa
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1484 - protein, 18 aa, Equus caballus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1485 - protein, 18 aa, Gallus gallus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1486 - protein, 18 aa, Felis catus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1487 - protein, 18 aa, Canis lupus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1488 - protein, 18 aa, Oryctolagus cuniculus
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1489 - protein, 18 aa, Ovis aries
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1490 - protein, 18 aa, artificial
  Concensus sequence
  misc_feature (7)..(7): Xaa can be lysine or homocitrulline
  misc_feature (9)..(9): Xaa can be lysine or homocitrulline
  misc_feature (16)..(16): Xaa can be lysine or homocitrulline
TTSEYEXEXLNERLAXLS

SEQ ID NO: 1491 - protein, 20 aa, Murine
  misc_feature (7)..(7): Xaa can be lysine or homocitrulline
GIIDPTXVVRTALLDAAGVA

SEQ ID NO: 1492 - protein, 20 aa, Rattus rattus
  misc_feature (7)..(7): Xaa can be lysine or homocitrulline
GIIDPTXVVRTALLDAAGVA

SEQ ID NO: 1493 - protein, 20 aa, Bos taurus
  misc_feature (7)..(7): Xaa can be lysine or homocitrulline
GIIDPTXVVRTALLDAAGVA

SEQ ID NO: 1494 - protein, 20 aa, Sus scrofa
  misc_feature (7)..(7): Xaa can be lysine or homocitrulline
GIIDPTXVVRTALLDAAGVA

SEQ ID NO: 1495 - protein, 20 aa, Equus caballus
  misc_feature (7)..(7): Xaa can be lysine or homocitrulline
GIIDPTXVVRTALLDAAGVA

SEQ ID NO: 1496 - protein, 20 aa, Felis catus
  misc_feature (7)..(7): Xaa can be lysine or homocitrulline
GIIDPTXVVRTALLDAAGVA

SEQ ID NO: 1497 - protein, 20 aa, Canis lupus
  misc_feature (7)..(7): Xaa can be lysine or homocitrulline
GIIDPTXVVRTALLDAAGVA

SEQ ID NO: 1498 - protein, 20 aa, Oryctolagus cuniculus
  misc_feature (7)..(7): Xaa can be lysine or homocitrulline
GIIDPTXVVRTALLDAAGVA

SEQ ID NO: 1499 - protein, 20 aa, Ovis aries
  misc_feature (7)..(7): Xaa can be lysine or homocitrulline
GIIDPTXVVRTALLDAAGVA

SEQ ID NO: 1500 - protein, 20 aa, artificial
  Concensus sequence
  misc_feature (7)..(7): Xaa can be lysine or homocitrulline
GIIDPTXVVRTALLDAAGVA

SEQ ID NO: 1501 - DNA, 54 bp, Homo sapiens
gatgctggaatcacccagagcccaagacacaaggtcacagagacaggaacacca

SEQ ID NO: 1502 - DNA, 338 bp, Homo sapiens
gtgactctgagatgtcatcagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagcgccgggaccaagagacccagtacttcgggccaggcacgcggctcctggtgctcgaggacctgaaaaacgtgttcccacccgaggtcgctgtgtttgagccatcaga

SEQ ID NO: 1503 - DNA, 392 bp, Homo sapiens
tctgatggctcaaacacagcgacctcgggtgggaacacgtttttcaggtcctcgagcaccaggagccgcgtgcctggcccgaagtactgggtctcttggtcccggcgctcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctgatgacatctcagagtcactggtgttcctgtctctgtgaccttgtgtcttgggctctgggtgattccagcatc

SEQ ID NO: 1504 - DNA, 51 bp, Homo sapiens
gatgctaagaccacacagccaaattcaatggagagtaacgaagaagagcct

SEQ ID NO: 1505 - DNA, 322 bp, Homo sapiens
gttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacgtttacgactacaagctcagctttggagccggaaccacagtaactgtaagagcaaatatccagaaccctgaccctgccgtgtaccagctgagagact

SEQ ID NO: 1506 - DNA, 373 bp, Homo sapiens
agtctctcagctggtacacggcagggtcagggttctggatatttgctcttacagttactgtggttccggctccaaagctgagcttgtagtcgtaaacgtctctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1507 - DNA, 54 bp, Homo sapiens
ggtgctgtcgtctctcaacatccgagctgggttatctgtaagagtggaacctct

SEQ ID NO: 1508 - DNA, 341 bp, Homo sapiens
gtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgccccaatacatacagatacgcagtattttggcccaggcacccggctgacagtgctcgaggacctgaaaaacgtgttcccacccgaggtcgctgtgtttgagccatcaga

SEQ ID NO: 1509 - DNA, 395 bp, Homo sapiens
tctgatggctcaaacacagcgacctcgggtgggaacacgtttttcaggtcctcgagcactgtcagccgggtgcctgggccaaaatactgcgtatctgtatgtattggggcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcacc

SEQ ID NO: 1510 - DNA, 39 bp, Homo sapiens
gaagacaaggtggtacaaagccctctatctctggttgtc

SEQ ID NO: 1511 - DNA, 334 bp, Homo sapiens
cacgagggagacactgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaacttttcagcatcctgaacatcacagccacccagaccggagactcggccgtctacctctgtgctgtgcacgatgcaggcaacatgctcacctttggagggggaacaaggttaatggtcaaaccccatatccagaaccctgaccctgccgtgtaccagctgagagact

SEQ ID NO: 1512 - DNA, 373 bp, Homo sapiens
agtctctcagctggtacacggcagggtcagggttctggatatggggtttgaccattaaccttgttccccctccaaaggtgagcatgttgcctgcatcgtgcacagcacagaggtagacggccgagtctccggtctgggtggctgtgatgttcaggatgctgaaaagttctttcttatctaatatgctacttagtcttcctgacttcttttcaattccacttgaagttagcataaatagaaatgtgggagctttcttttcctgcttgtaccatagtaggcttcgaaagttagtcacttcataactgcaattgagagttacagtgtctccctcgtggacaaccagagatagagggctttgtaccaccttgtcttc

SEQ ID NO: 1513 - DNA, 54 bp, Homo sapiens
gatgctggagttatccagtcaccccggcacgaggtgacagagatgggacaagaa

SEQ ID NO: 1514 - DNA, 341 bp, Homo sapiens
gtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagggggggactagcctccaatgagcagttcttcgggccagggacacggctcaccgtgctagaggacctgaaaaacgtgttcccacccgaggtcgctgtgtttgagccatcaga

SEQ ID NO: 1515 - DNA, 395 bp, Homo sapiens
tctgatggctcaaacacagcgacctcgggtgggaacacgtttttcaggtcctctagcacggtgagccgtgtccctggcccgaagaactgctcattggaggctagtccccccctgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatc

SEQ ID NO: 1516 - DNA, 51 bp, Homo sapiens
gcccagtctgtgacccagcttgacagccaagtccctgtctttgaagaagcc

SEQ ID NO: 1517 - DNA, 334 bp, Homo sapiens
cctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagtgaaggcggaggaagctacatacctacatttggaagaggaaccagccttattgttcatccgtatatccagaaccctgaccctgccgtgtaccagctgagagact

SEQ ID NO: 1518 - DNA, 385 bp, Homo sapiens
agtctctcagctggtacacggcagggtcagggttctggatatacggatgaacaataaggctggttcctcttccaaatgtaggtatgtagcttcctccgccttcactcacagcacagaagtactcagccgtgtcgcttatatggactgagggtttcctcaagtggaaggaagtttgactcttgttaaattcagcctcaaaaccgttgatgcctttaaccagggtggatcctgataaatacttcaggagaagctggagtccttggttggggtattgcacataccagaagagatacactgaaacagacgatgagtagttgcacctcagctccacaggggcttcttcaaagacagggacttggctgtcaagctgggtcacagactgggc

SEQ ID NO: 1519 - DNA, 54 bp, Homo sapiens
gatggtggaatcactcagtccccaaagtacctgttcagaaaggaaggacagaat

SEQ ID NO: 1520 - DNA, 335 bp, Homo sapiens
gtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtctcgggacattctacgagcagtacttcgggccgggcaccaggctcacggtcacagaggacctgaaaaacgtgttcccacccgaggtcgctgtgtttgagccatcaga

SEQ ID NO: 1521 - DNA, 389 bp, Homo sapiens
tctgatggctcaaacacagcgacctcgggtgggaacacgtttttcaggtcctctgtgaccgtgagcctggtgcccggcccgaagtactgctcgtagaatgtcccgagactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatc

SEQ ID NO: 1522 - DNA, 54 bp, Homo sapiens
ggagagaatgtggagcagcatccttcaaccctgagtgtccaggagggagacagc

SEQ ID NO: 1523 - DNA, 328 bp, Homo sapiens
gctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtggtaacaccaatgcaggcaaatcaacctttggggatgggactacgctcactgtgaagccaaatatccagaaccctgaccctgccgtgtaccagctgagagact

SEQ ID NO: 1524 - DNA, 382 bp, Homo sapiens
agtctctcagctggtacacggcagggtcagggttctggatatttggcttcacagtgagcgtagtcccatccccaaaggttgatttgcctgcattggtgttaccacttgctgcacagaagtagacagccgagtcttcaggttgggtctctgtgatgtgcagggagaaatgtttggctgtcttgttcaatgtaacagcaattcgttggtctttcttttcgcccacatttgaacgaatgtctataataagctgaggtccttttccaagttcttgcttataccaagggaagtagtttgaggcactgtctgaataagtacacttgataacagcgctgtctccctcctggacactcagggttgaaggatgctgctccacattctctcc

SEQ ID NO: 1525 - DNA, 45 bp, Homo sapiens
aaggctggagtcactcaaactccaagatatctgatcaaaacgaga

SEQ ID NO: 1526 - DNA, 356 bp, Homo sapiens
ggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttaggtgttatggtcgttagtacagatacgcagtattttggcccaggcacccggctgacagtgctcgaggacctgaaaaacgtgttcccacccgaggtcgctgtgtttgagccatcaga

SEQ ID NO: 1527 - DNA, 401 bp, Homo sapiens
tctgatggctcaaacacagcgacctcgggtgggaacacgtttttcaggtcctcgagcactgtcagccgggtgcctgggccaaaatactgcgtatctgtactaacgaccataacacctaagctgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctt

SEQ ID NO: 1528 - DNA, 334 bp, Homo sapiens
gttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacagggtctctaactttggaaatgagaaattaacctttgggactggaacaagactcaccatcatacccaatatccagaaccctgaccctgccgtgtaccagctgagagact

SEQ ID NO: 1529 - DNA, 385 bp, Homo sapiens
agtctctcagctggtacacggcagggtcagggttctggatattgggtatgatggtgagtcttgttccagtcccaaaggttaatttctcatttccaaagttagagaccctgtctctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1530 - DNA, 57 bp, Homo sapiens
gaagctggagttgcccagtctcccagatataagattatagagaaaaggcagagtgtg

SEQ ID NO: 1531 - DNA, 341 bp, Homo sapiens
gctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcccgacgcagggggcgtcctacgagcagtacttcgggccgggcaccaggctcacggtcacagaggacctgaaaaacgtgttcccacccgaggtcgctgtgtttgagccatcaga

SEQ ID NO: 1532 - DNA, 398 bp, Homo sapiens
tctgatggctcaaacacagcgacctcgggtgggaacacgtttttcaggtcctctgtgaccgtgagcctggtgcccggcccgaagtactgctcgtaggacgccccctgcgtcgggctgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttc

SEQ ID NO: 1533 - DNA, 54 bp, Homo sapiens
gctcagtcagtggctcagccggaagatcaggtcaacgttgctgaagggaatcct

SEQ ID NO: 1534 - DNA, 328 bp, Homo sapiens
ctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagacgcaggatacagcaccctcacctttgggaaggggactatgcttctagtctctccagatatccagaaccctgaccctgccgtgtaccagctgagagact

SEQ ID NO: 1535 - DNA, 382 bp, Homo sapiens
agtctctcagctggtacacggcagggtcagggttctggatatctggagagactagaagcatagtccccttcccaaaggtgagggtgctgtatcctgcgtctctcacagcacagaagtacaaagcggagtcgctcacaagggcagatggtttcttcaggtggaaggaggtttggctcttgttaaattcagcttcaaagccatagctgcctttaaccaggttatcccctgtgatgtatttcagaaggaactggaggcctcggttggggtattgaacataccaaaaaagataagggtttccagagactgaataggtgcatttcacagtcagaggattcccttcagcaacgttgacctgatcttccggctgagccactgactgagc

SEQ ID NO: 1536 - DNA, 48 bp, Homo sapiens
ggagagaatgtggagcagcatccttcaaccctgagtgtccaggaggga

SEQ ID NO: 1537 - DNA, 331 bp, Homo sapiens
gacagcgctgttatcaagtgcacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtatcgacagagatgacaagatcatctttggaaaagggacacgacttcatattctccccaatatccagaaccctgaccctgccgtgtaccagctgagagact

SEQ ID NO: 1538 - DNA, 379 bp, Homo sapiens
agtctctcagctggtacacggcagggtcagggttctggatattggggagaatatgaagtcgtgtcccttttccaaagatgatcttgtcatctctgtcgatacttgctgcacagaagtagacagccgagtcttcaggttgggtctctgtgatgtgcagggagaaatgtttggctgtcttgttcaatgtaacagcaattcgttggtctttcttttcgcccacatttgaacgaatgtctataataagctgaggtccttttccaagttcttgcttataccaagggaagtagtttgaggcactgtctgaataagtgcacttgataacagcgctgtctccctcctggacactcagggttgaaggatgctgctccacattctctcc

SEQ ID NO: 1539 - DNA, 48 bp, Homo sapiens
gatgtgaaagtaacccagagctcgagatatctagtcaaaaggacggga

SEQ ID NO: 1540 - DNA, 341 bp, Homo sapiens
gagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccactactcaggggtcctacaatgagcagttcttcgggccagggacacggctcaccgtgctagaggacctgaaaaacgtgttcccacccgaggtcgctgtgtttgagccatcaga

SEQ ID NO: 1541 - DNA, 389 bp, Homo sapiens
tctgatggctcaaacacagcgacctcgggtgggaacacgtttttcaggtcctctagcacggtgagccgtgtccctggcccgaagaactgctcattgtaggacccctgagtagtggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatc

SEQ ID NO: 1542 - DNA, 36 bp, Homo sapiens
gaagaccaggtgacgcagagtcccgaggccctgaga

SEQ ID NO: 1543 - DNA, 334 bp, Homo sapiens
ctccaggagggagagagtagcagtctcaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggctggaagctacatacctacatttggaagaggaaccagccttattgttcatccgtatatccagaaccctgaccctgccgtgtaccagctgagagact

SEQ ID NO: 1544 - DNA, 370 bp, Homo sapiens
agtctctcagctggtacacggcagggtcagggttctggatatacggatgaacaataaggctggttcctcttccaaatgtaggtatgtagcttccagcctgcacagcacagagataagtggctgagtcttcaggtttaggggctgtgatgtgcagaaagctttccttctttgttaatgtggcttttagcctttctttctccttttcttccccagctgaatacagggtgaagaggaattcagggcctttcccaggatcttgcctataccagaacagccctcttaaaccgctgactgtgtaactgcagttgagactgctactctctccctcctggagtctcagggcctcgggactctgcgtcacctggtcttc

SEQ ID NO: 1545 - DNA, 344 bp, Homo sapiens
gtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctcggactagcgggacgaatacgcagtattttggcccaggcacccggctgacagtgctcgaggacctgaaaaacgtgttcccacccgaggtcgctgtgtttgagccatcaga

SEQ ID NO: 1546 - DNA, 398 bp, Homo sapiens
tctgatggctcaaacacagcgacctcgggtgggaacacgtttttcaggtcctcgagcactgtcagccgggtgcctgggccaaaatactgcgtattcgtcccgctagtccgagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcacc

SEQ ID NO: 1547 - DNA, 57 bp, Homo sapiens
gcccagtcggtgacccagcttggcagccacgtctctgtctctgaaggagccctggtt

SEQ ID NO: 1548 - DNA, 325 bp, Homo sapiens
ctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagcggtcgtaacgactacaagctcagctttggagccggaaccacagtaactgtaagagcaaatatccagaaccctgaccctgccgtgtaccagctgagagact

SEQ ID NO: 1549 - DNA, 382 bp, Homo sapiens
agtctctcagctggtacacggcagggtcagggttctggatatttgctcttacagttactgtggttccggctccaaagctgagcttgtagtcgttacgaccgctcacagcacagaagtactcagccgcgtcgctcatatgggctgagggtttcgtcaggtggaaggaggtttcactcttcttaaattcagcctcaaaaccgttgatgcctttaaccagggtggccgctgatgtgtacttcaggagaagctggagtccttggttggggtattgcacataccagaagagatatggtggaacagacgatgagtagttgcacctcagcagaaccagggctccttcagagacagagacgtggctgccaagctgggtcaccgactgggc

SEQ ID NO: 1550 - DNA, 51 bp, Homo sapiens
aatgctggtgtcactcagaccccaaaattccgggtcctgaagacaggacag

SEQ ID NO: 1551 - DNA, 341 bp, Homo sapiens
agcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtcgctcctggacagcaagtggctacaccttcggttcggggaccaggttaaccgttgtagaggacctgaacaaggtgttcccacccgaggtcgctgtgtttgagccatcaga

SEQ ID NO: 1552 - DNA, 392 bp, Homo sapiens
tctgatggctcaaacacagcgacctcgggtgggaacaccttgttcaggtcctctacaacggttaacctggtccccgaaccgaaggtgtagccacttgctgtccaggagcgactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcatt

SEQ ID NO: 1553 - DNA, 48 bp, Homo sapiens
gatgctaagaccacacagccaaattcaatggagagtaacgaagaagag

SEQ ID NO: 1554 - DNA, 328 bp, Homo sapiens
cctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagacgggtccggaaatgagaaattaacctttgggactggaacaagactcaccatcatacccaatatccagaaccctgaccctgccgtgtaccagctgagagact

SEQ ID NO: 1555 - DNA, 376 bp, Homo sapiens
agtctctcagctggtacacggcagggtcagggttctggatattgggtatgatggtgagtcttgttccagtcccaaaggttaatttctcatttccggacccgtctctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1556 - DNA, 54 bp, Homo sapiens
gatgctggagttatccagtcaccccgccatgaggtgacagagatgggacaagaa

SEQ ID NO: 1557 - DNA, 347 bp, Homo sapiens
gtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgtggcccaactagcgggaaagggtgagcagttcttcgggccagggacacggctcaccgtgctagaggacctgaaaaacgtgttcccacccgaggtcgctgtgtttgagccatcaga

SEQ ID NO: 1558 - DNA, 401 bp, Homo sapiens
tctgatggctcaaacacagcgacctcgggtgggaacacgtttttcaggtcctctagcacggtgagccgtgtccctggcccgaagaactgctcaccctttcccgctagttgggccacactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatc

SEQ ID NO: 1559 - DNA, 51 bp, Homo sapiens
gaacctgaagtcacccagactcccagccatcaggtcacacagatgggacag

SEQ ID NO: 1560 - DNA, 341 bp, Homo sapiens
gaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagaagggtaatgggctatggctacaccttcggttcggggaccaggttaaccgttgtagaggacctgaacaaggtgttcccacccgaggtcgctgtgtttgagccatcaga

SEQ ID NO: 1561 - DNA, 392 bp, Homo sapiens
tctgatggctcaaacacagcgacctcgggtgggaacaccttgttcaggtcctctacaacggttaacctggtccccgaaccgaaggtgtagccatagcccattacccttctgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttc

SEQ ID NO: 1562 - DNA, 54 bp, Homo sapiens
aaacaggaggtgacgcagattcctgcagctctgagtgtcccagaaggagaaaac

SEQ ID NO: 1563 - DNA, 328 bp, Homo sapiens
ttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctctgaatagtggaggtagcaactataaactgacatttggaaaaggaactctcttaaccgtgaatccaaatatccagaaccctgaccctgccgtgtaccagctgagagact

SEQ ID NO: 1564 - DNA, 382 bp, Homo sapiens
agtctctcagctggtacacggcagggtcagggttctggatatttggattcacggttaagagagttccttttccaaatgtcagtttatagttgctacctccactattcagagcacagaggtaggtggctgagtcaccaggctgagaagctgcaatgtataaagtactacgtcctgatgatttatccagcgaggcattaagtcttccacttgtttgctctctctgacttgactgaataagcaacagagatgtgagacctttcccagggtcctgcctaaaccactggaggttgtaaatagcgctatcagtgaaactgcagttgagaaccaagttttctccttctgggacactcagagctgcaggaatctgcgtcacctcctgttt

SEQ ID NO: 1565 - DNA, 48 bp, Homo sapiens
ggtgctgtcgtctctcaacatccgagctgggttatctgtaagagtgga

SEQ ID NO: 1566 - DNA, 359 bp, Homo sapiens
acctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgccggccgggcggggactagcggaacatacgagcagtacttcgggccgggcaccaggctcacggtcacagaggacctgaaaaacgtgttcccacccgaggtcgctgtgtttgagccatcaga

SEQ ID NO: 1567 - protein, 134 aa, Homo sapiens
  misc_feature (14)..(14): Xaa can be lysine or homocitrulline
  misc_feature (20)..(20): Xaa can be lysine or homocitrulline
  misc_feature (41)..(41): Xaa can be lysine or homocitrulline
  misc_feature (55)..(55): Xaa can be lysine or homocitrulline
  misc_feature (64)..(64): Xaa can be lysine or homocitrulline
  misc_feature (66)..(66): Xaa can be lysine or homocitrulline
  misc_feature (121)..(121): Xaa can be lysine or homocitrulline
GAVVSQHPSWVICXSGTSVXIECRSLDFQATTMFWYRQFPXQSLMLMATSNEGSXATYEQGVEXDXFLINHASLTLSTLVTSAHPEDSSFYICSAGRAGTSGTYEQYFGPGTRLTVTEDLXNVFPPEVAVFEPS

SEQ ID NO: 1568 - DNA, 407 bp, Homo sapiens
tctgatggctcaaacacagcgacctcgggtgggaacacgtttttcaggtcctctgtgaccgtgagcctggtgcccggcccgaagtactgctcgtatgttccgctagtccccgcccggccggcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcacc

SEQ ID NO: 1569 - DNA, 328 bp, Homo sapiens
cctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagatctaactttggaaatgagaaattaacctttgggactggaacaagactcaccatcatacccaatatccagaaccctgaccctgccgtgtaccagctgagagact

SEQ ID NO: 1570 - DNA, 376 bp, Homo sapiens
agtctctcagctggtacacggcagggtcagggttctggatattgggtatgatggtgagtcttgttccagtcccaaaggttaatttctcatttccaaagttagatctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1571 - DNA, 338 bp, Homo sapiens
gtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgggggacagttcaatcagccccagcattttggtgatgggactcgactctccatcctagaggacctgaacaaggtgttcccacccgaggtcgctgtgtttgagccatcaga

SEQ ID NO: 1572 - DNA, 392 bp, Homo sapiens
tctgatggctcaaacacagcgacctcgggtgggaacaccttgttcaggtcctctaggatggagagtcgagtcccatcaccaaaatgctggggctgattgaactgtcccccactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatc

SEQ ID NO: 1573 - DNA, 51 bp, Homo sapiens
agccaaaagatagaacagaattccgaggccctgaacattcaggagggtaaa

SEQ ID NO: 1574 - DNA, 328 bp, Homo sapiens
acggccaccctgacctgcaactatacaaactattctccagcatacttacagtggtaccgacaagatccaggaagaggccctgttttcttgctacttatacgtgaaaatgagaaagaaaaaaggaaagaaagactgaaggtcacctttgataccacccttaaacagagtttgtttcatatcacagcctcccagcctgcagactcagctacctacctctgtgctctagggcaaactggggcaaacaacctcttctttgggactggaacgagactcaccgttattccctatatccagaaccctgaccctgccgtgtaccagctgagagact

SEQ ID NO: 1575 - DNA, 379 bp, Homo sapiens
agtctctcagctggtacacggcagggtcagggttctggatatagggaataacggtgagtctcgttccagtcccaaagaagaggttgtttgccccagtttgccctagagcacagaggtaggtagctgagtctgcaggctgggaggctgtgatatgaaacaaactctgtttaagggtggtatcaaaggtgaccttcagtctttctttccttttttctttctcattttcacgtataagtagcaagaaaacagggcctcttcctggatcttgtcggtaccactgtaagtatgctggagaatagtttgtatagttgcaggtcagggtggccgttttaccctcctgaatgttcagggcctcggaattctgttctatcttttggct

SEQ ID NO: 1576 - DNA, 54 bp, Homo sapiens
aatgccggcgtcatgcagaacccaagacacctggtcaggaggaggggacaggag

SEQ ID NO: 1577 - DNA, 347 bp, Homo sapiens
gcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcacccgaggctctggcgaacaccggggagctgttttttggagaaggctctaggctgaccgtactggaggacctgaaaaacgtgttcccacccgaggtcgctgtgtttgagccatcaga

SEQ ID NO: 1578 - DNA, 401 bp, Homo sapiens
tctgatggctcaaacacagcgacctcgggtgggaacacgtttttcaggtcctccagtacggtcagcctagagccttctccaaaaaacagctccccggtgttcgccagagcctcgggtgagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatt

SEQ ID NO: 1579 - DNA, 18 bp, Homo sapiens
gatgctaagaccacccag

SEQ ID NO: 1580 - DNA, 30 bp, Homo sapiens
cccccctccatggattgcgctgaaggaaga

SEQ ID NO: 1581 - DNA, 328 bp, Homo sapiens
gctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtggggtacaataacaatgacatgcgctttggagcagggaccagactgacagtaaaaccaaatatccagaaccctgaccctgccgtgtaccagctgagagact

SEQ ID NO: 1582 - DNA, 376 bp, Homo sapiens
agtctctcagctggtacacggcagggtcagggttctggatatttggttttactgtcagtctggtccctgctccaaagcgcatgtcattgttattgtaccccactctgacgatgcaatagtacacagcagtgtctctcagcgtagcgtggggcaggatcaaggtgctggactttctgtcttctgtgatgatcagagaggccatttcattggtttcattgttttttagaccatgaatgatatactgtggcccctgggagtgaatctgtcgataccaatacacatactcatttccactgatggtagagtgattacaaggcaggtttgcagctcttccttcagcgcaatccatggaggggggctgggtggtcttagcatc

SEQ ID NO: 1583 - DNA, 54 bp, Homo sapiens
gatgctgatgttacccagaccccaaggaataggatcacaaagacaggaaagagg

SEQ ID NO: 1584 - DNA, 341 bp, Homo sapiens
attatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgaccctagcgggcccccctacgagcagtacttcgggccgggcaccaggctcacggtcacagaggacctgaaaaacgtgttcccacccgaggtcgctgtgtttgagccatcaga

SEQ ID NO: 1585 - DNA, 395 bp, Homo sapiens
tctgatggctcaaacacagcgacctcgggtgggaacacgtttttcaggtcctctgtgaccgtgagcctggtgcccggcccgaagtactgctcgtaggggggcccgctagggtcactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatc

SEQ ID NO: 1586 - DNA, 325 bp, Homo sapiens
gttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagctcagggcggatctgaaaagctggtctttggaaagggaacgaaactgacagtaaacccatatatccagaaccctgaccctgccgtgtaccagctgagagact

SEQ ID NO: 1587 - DNA, 376 bp, Homo sapiens
agtctctcagctggtacacggcagggtcagggttctggatatatgggtttactgtcagtttcgttccctttccaaagaccagcttttcagatccgccctgagctctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1588 - DNA, 344 bp, Homo sapiens
gaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagagccgggacagggatagggggctacaccttcggttcggggaccaggttaaccgttgtagaggacctgaacaaggtgttcccacccgaggtcgctgtgtttgagccatcaga

SEQ ID NO: 1589 - DNA, 395 bp, Homo sapiens
tctgatggctcaaacacagcgacctcgggtgggaacaccttgttcaggtcctctacaacggttaacctggtccccgaaccgaaggtgtagccccctatccctgtcccggctctgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttc

SEQ ID NO: 1590 - DNA, 328 bp, Homo sapiens
ttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtttatagtggaggtagcaactataaactgacatttggaaaaggaactctcttaaccgtgaatccaaatatccagaaccctgaccctgccgtgtaccagctgagagact

SEQ ID NO: 1591 - DNA, 382 bp, Homo sapiens
agtctctcagctggtacacggcagggtcagggttctggatatttggattcacggttaagagagttccttttccaaatgtcagtttatagttgctacctccactataaacagcacagaggtaggtggctgagtcaccaggctgagaagctgcaatgtataaagtactacgtcctgatgatttatccagcgaggcattaagtcttccacttgtttgctctctctgacttgactgaataagcaacagagatgtgagacctttcccagggtcctgcctaaaccactggaggttgtaaatagcgctatcagtgaaactgcagttgagaaccaagttttctccttctgggacactcagagctgcaggaatctgcgtcacctcctgttt

SEQ ID NO: 1592 - protein, 10 aa, Homo sapiens
ATPGPANNLF

SEQ ID NO: 1593 - DNA, 57 bp, Homo sapiens
gatgtgaaagtaacccagagctcgagatatctagtcaaaaggacgggagagaaagtt

SEQ ID NO: 1594 - DNA, 332 bp, Homo sapiens
tttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttattggggagctcacccctccactttgggaatgggaccaggctcactgtgacagaggacctgaacaaggtgttcccacccgaggtcgctgtgtttgagccatcaga

SEQ ID NO: 1595 - DNA, 389 bp, Homo sapiens
tctgatggctcaaacacagcgacctcgggtgggaacaccttgttcaggtcctctgtcacagtgagcctggtcccattcccaaagtggaggggtgagctccccaataaactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatc

SEQ ID NO: 1596 - DNA, 54 bp, Homo sapiens
gctcagacagtcactcagtctcaaccagagatgtctgtgcaggaggcagagacc

SEQ ID NO: 1597 - DNA, 334 bp, Homo sapiens
gtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagttataaccagggaggaaagcttatcttcggacagggaacggagttatctgtgaaacccaatatccagaaccctgaccctgccgtgtaccagctgagagact

SEQ ID NO: 1598 - DNA, 388 bp, Homo sapiens
agtctctcagctggtacacggcagggtcagggttctggatattgggtttcacagataactccgttccctgtccgaagataagctttcctccctggttataactcctataagcacagaaatacatcgcggcatcccccagctgtgagtctgagatcttgagactgaaggatttggctgctttctggaagttcacagagaaacgattctctgttgcattctgttgcttataagcttcttggcgaataacgagaatcatctgcctgctgggaggctgcttgtaccagaataaataataatcactctcactggtgtcatatgtgcagctcagggtcacggtctctgcctcctgcacagacatctctggttgagactgagtgactgtctgagc

SEQ ID NO: 1599 - DNA, 57 bp, Homo sapiens
gacacagctgtttcccagactccaaaatacctggtcacacagatgggaaacgacaag

SEQ ID NO: 1600 - DNA, 338 bp, Homo sapiens
tccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaagagcctagtacccacaatgagcagttcttcgggccagggacacggctcaccgtgctagaggacctgaaaaacgtgttcccacccgaggtcgctgtgtttgagccatcaga

SEQ ID NO: 1601 - DNA, 395 bp, Homo sapiens
tctgatggctcaaacacagcgacctcgggtgggaacacgtttttcaggtcctctagcacggtgagccgtgtccctggcccgaagaactgctcattgtgggtactaggctcttggctgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtc

SEQ ID NO: 1602 - DNA, 328 bp, Homo sapiens
gttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgaagaattatggaggaagccaaggaaatctcatctttggaaaaggcactaaactctctgttaaaccaaatatccagaaccctgaccctgccgtgtaccagctgagagact

SEQ ID NO: 1603 - DNA, 379 bp, Homo sapiens
agtctctcagctggtacacggcagggtcagggttctggatatttggtttaacagagagtttagtgccttttccaaagatgagatttccttggcttcctccataattcttcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatc

SEQ ID NO: 1604 - DNA, 51 bp, Homo sapiens
aatgctggtgtcactcagaccccaaaattccgcatcctgaagataggacag

SEQ ID NO: 1605 - DNA, 338 bp, Homo sapiens
agcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagcccgggacagccctatggctacaccttcggttcggggaccaggttaaccgttgtagaggacctgaacaaggtgttcccacccgaggtcgctgtgtttgagccatcaga

SEQ ID NO: 1606 - DNA, 389 bp, Homo sapiens
tctgatggctcaaacacagcgacctcgggtgggaacaccttgttcaggtcctctacaacggttaacctggtccccgaaccgaaggtgtagccatagggctgtcccgggctgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcatt

SEQ ID NO: 1607 - DNA, 54 bp, Homo sapiens
gcccagagagtgactcagcccgagaagctcctctctgtctttaaaggggcccca

SEQ ID NO: 1608 - DNA, 319 bp, Homo sapiens
gtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtggcccgagctatggtcagaattttgtctttggtcccggaaccagattgtccgtgctgccctatatccagaaccctgaccctgccgtgtaccagctgagagact

SEQ ID NO: 1609 - DNA, 373 bp, Homo sapiens
agtctctcagctggtacacggcagggtcagggttctggatatagggcagcacggacaatctggttccgggaccaaagacaaaattctgaccatagctcgggccacttagagcacagtaatacatggctgagtcttcctcttgagcaaatggtttcttcaggtggaaagatgtctcgcctttgttaaggtcagcagtgaagcctttgatgctctctctagagatgtgtctcaagagtaactggaggcgttgtctggagtactggacataccagaagagttcaggactcccagaataggaatagttgcacttcagctccactggggcccctttaaagacagagaggagcttctcgggctgagtcactctctgggc

SEQ ID NO: 1610 - DNA, 51 bp, Homo sapiens
aatgctggtgtcactcagaccccaaaattccaggtcctgaagacaggacag

SEQ ID NO: 1611 - DNA, 341 bp, Homo sapiens
agcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcgagggactagcctcctacaatgagcagttcttcgggccagggacacggctcaccgtgctagaggacctgaaaaacgtgttcccacccgaggtcgctgtgtttgagccatcaga

SEQ ID NO: 1612 - DNA, 392 bp, Homo sapiens
tctgatggctcaaacacagcgacctcgggtgggaacacgtttttcaggtcctctagcacggtgagccgtgtccctggcccgaagaactgctcattgtaggaggctagtccctcgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcatt

SEQ ID NO: 1613 - DNA, 54 bp, Homo sapiens
ggaaattcagtgacccagatggaagggccagtgactctctcagaagaggccttc

SEQ ID NO: 1614 - DNA, 325 bp, Homo sapiens
ctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctaacgggggggggttaccagaaagttacctttggaactggaacaaagctccaagtcatcccaaatatccagaaccctgaccctgccgtgtaccagctgagagact

SEQ ID NO: 1615 - DNA, 379 bp, Homo sapiens
agtctctcagctggtacacggcagggtcagggttctggatatttgggatgacttggagctttgttccagttccaaaggtaactttctggtaacccccccccgttagagcacagaagtacaccgctgagtctgacacttgaactgagcctttctccaagtggaaagaagtggtttctttacggtatgtggcttcaaaacctttgttgcttcccttgtcatcagccttcgtggctttcaggaggagctgtagaccttctccaggatattggacataccagaaaagggaagggtatcctgtggctgtgtacgtgcagtttatagtcaggaaggcctcttctgagagagtcactggcccttccatctgggtcactgaatttcc

SEQ ID NO: 1616 - DNA, 57 bp, Homo sapiens
gaagcccaagtgacccagaacccaagatacctcatcacagtgactggaaagaagtta

SEQ ID NO: 1617 - DNA, 332 bp, Homo sapiens
acagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttcagggagggtgaaaaactgttttttggcagtggaacccagctctctgtcttggaggacctgaacaaggtgttcccacccgaggtcgctgtgtttgagccatcaga

SEQ ID NO: 1618 - DNA, 389 bp, Homo sapiens
tctgatggctcaaacacagcgacctcgggtgggaacaccttgttcaggtcctccaagacagagagctgggttccactgccaaaaaacagtttttcaccctccctgaaactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttc

SEQ ID NO: 1619 - DNA, 54 bp, Homo sapiens
agtcaacagggagaagaggatcctcaggccttgagcatccaggagggtgaaaat

SEQ ID NO: 1620 - DNA, 325 bp, Homo sapiens
gccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggcgatgaacacaggctttcagaaacttgtatttggaactggcacccgacttctggtcagtccaaatatccagaaccctgaccctgccgtgtaccagctgagagact

SEQ ID NO: 1621 - DNA, 379 bp, Homo sapiens
agtctctcagctggtacacggcagggtcagggttctggatatttggactgaccagaagtcgggtgccagttccaaatacaagtttctgaaagcctgtgttcatcgccgtagcacagaagtaagaagcagtgtctgctgcccgggaagccgtgatcaacaaggaactgcttttcttggaagtgtcaagcgtgactcttaatcttccactgtgtttctctctttcatttgaacgtattaaaattaggtggacaaggcctctacctgaattttgtctataccactgtaaattgtttatactagttttgtaactgcagttcatggtggcattttcaccctcctggatgctcaaggcctgaggatcctcttctccctgttgact

SEQ ID NO: 1622 - DNA, 60 bp, Homo sapiens
gaaacgggagttacgcagacaccaagacacctggtcatgggaatgacaaataagaagtct

SEQ ID NO: 1623 - DNA, 338 bp, Homo sapiens
ttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccgggagggactagcgggattaaatgagcagttcttcgggccagggacacggctcaccgtgctagaggacctgaaaaacgtgttcccacccgaggtcgctgtgtttgagccatcaga

SEQ ID NO: 1624 - DNA, 398 bp, Homo sapiens
tctgatggctcaaacacagcgacctcgggtgggaacacgtttttcaggtcctctagcacggtgagccgtgtccctggcccgaagaactgctcatttaatcccgctagtccctcccggctgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttc

SEQ ID NO: 1625 - DNA, 45 bp, Homo sapiens
gaccagcaagttaagcaaaattcaccatccctgagcgtccaggaa

SEQ ID NO: 1626 - DNA, 346 bp, Homo sapiens
ggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcggctggggtgatggtggtgctacaaacaagctcatctttggaactggcactctgcttgctgtccagccaaatatccagaaccctgaccctgccgtgtaccagctgagagact

SEQ ID NO: 1627 - DNA, 391 bp, Homo sapiens
agtctctcagctggtacacggcagggtcagggttctggatatttggctggacagcaagcagagtgccagttccaaagatgagcttgtttgtagcaccaccatcaccccagccgcttgctgcacagaagtacactgcagagtctccaggctgggagggcacaatgtgcagagagaggtgcttggcacttttgtttaagaagacagtgaatcttccatcttcatttttatccttaatggaacttatagatatcaggaatgtaggaccttcagcagggtattttttgtaccataggaaataatcaaacatgctgttagtatagtcacagttcagaatagaaattcttccttcctggacgctcagggatggtgaattttgcttaacttgctggtc

SEQ ID NO: 1628 - protein, 14 aa, Homo sapiens
  misc_feature (7)..(7): Xaa is citrulline
  misc_feature (10)..(10): Xaa can be lysine or homocitrulline
  misc_feature (12)..(12): Xaa can be lysine or homocitrulline
NQDFTNXINXLXNS

SEQ ID NO: 1629 - protein, 14 aa, Homo sapiens
  misc_feature (5)..(5): Xaa is citrulline
LQYMXADQAAGGLR

The invention claimed is:

1. A method of treating cancer in a subject identified as having a tumor environment comprising myeloperoxidase (MPO)-expressing cells, wherein the MPO-expressing cells produce isocyanic acid that can diffuse into tumor cells and result in the carbamylation of epitopes in tumor cells in the tumor environment, wherein the resulting carbamylated epitopes each comprise at least one lysine amino acid residue that has been converted to homocitrulline and are presented on the surface of the tumor cells via MHC class I or II complexes, the method comprising administering to the subject a composition that comprises peptides comprising at least one of the carbamylated epitopes in an amount effective to induce production and/or secretion of IFN-gamma, granzyme B, and/or CD134 in T cells that bind the MHC class I or II complexes presented on the surface of the tumor cells.

2. The method of claim 1, wherein the subject has a solid tumor or a haematological neoplasia.

3. The method of claim 1, wherein the subject has pancreatic cancer, renal cancer, melanoma, head and neck cancer, breast cancer, lung cancer, Burkitt's lymphoma, chronic lymphocytic leukaemia, melanoma, pancreatic adenocarcinoma, breast cancer, colon cancer, acute lymphoblastic leukaemia or acute myeloid leukaemia.

4. The method of claim 1, wherein the T cells are CD4 T cells and/or CD8 T cells.

5. The method of claim 1, wherein the composition further comprises an adjuvant or pharmaceutically acceptable vaccine component.

6. The method of claim 5, wherein the adjuvant is a cytosine-phosphate-guanosine dinucleotide (CpG) oligonucleotide or monophosphoryl-lipid A (MPLA).

7. The method of claim 1, wherein the composition further comprises a CpG oligonucleotide adjuvant and/or a MPLA adjuvant.

8. The method of claim 1, wherein the MPO-expressing cells are monocytic and granulocytic myeloid derived suppressor cells (MDSC).

* * * * *